US007960612B2

(12) United States Patent
Zhang et al.

(10) Patent No.: US 7,960,612 B2
(45) Date of Patent: Jun. 14, 2011

(54) PLANT QUALITY WITH VARIOUS PROMOTERS

(75) Inventors: James Z. Zhang, Palo Alto, CA (US); Frederick D. Hempel, Hayward, CA (US); Luc J. Adam, Hayward, CA (US); Joseph M. Palys, Davis, CA (US); T. Lynne Reuber, San Mateo, CA (US); Oliver J. Ratcliffe, Oakland, CA (US); Robert A. Creelman, Castro Valley, CA (US); Raymond R. Samaha, Soquel, CA (US); Pierre E. Broun, St Cyr sur Loire (FR)

(73) Assignees: Mendel Biotechnology, Inc., Hayward, CA (US); Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 12/169,527

(22) Filed: Jul. 8, 2008

(65) Prior Publication Data

US 2009/0049566 A1 Feb. 19, 2009

Related U.S. Application Data

(60) Continuation-in-part of application No. 10/286,264, filed on Nov. 1, 2002, now abandoned, which is a division of application No. 09/533,030, filed on Mar. 22, 2000, now abandoned, said application No.12/169,527 is a continuation-in-part of application No. 11/479,226, filed on Jun. 30, 2006, now Pat. No. 7,858,848, and a continuation-in-part of application No. 10/675,852, filed on Sep. 30, 2003, which is a continuation-in-part of application No. 09/713,994, filed on Nov. 16, 2000, now abandoned, said application No. 12/169,527 is a continuation-in-part of application No. 10/669,824, filed on Sep. 23, 2003, which is a continuation-in-part of application No. 09/823,676, filed on Mar. 30, 2001, now Pat. No. 6,717,034, said application No. 12/169,527 is a continuation-in-part of application No. 11/725,235, filed on Mar. 16, 2007, now Pat. No. 7,601,893, which is a division of application No. 10/225,068, filed on Aug. 9, 2002, now Pat. No. 7,193,129, and a continuation-in-part of application No. 10/171,468, filed on Jun. 14, 2002, now abandoned, and a continuation-in-part of application No. 09/837,944, filed on Apr. 18, 2001, now abandoned, said application No. 12/169,527 is a continuation-in-part of application No. 11/728,567, filed on Mar. 26, 2007, now Pat. No. 7,635,860, which is a division of application No. 10/225,066, filed on Aug. 9, 2002, now Pat. No. 7,238,860, and a continuation-in-part of application No. 09/837,944, filed on Apr. 18, 2001, now abandoned, and a continuation-in-part of application No. 10/171,468, filed on Jun. 14, 2002, now abandoned, said application No. 12/169,527 is a continuation-in-part of application No. 11/375,241, filed on Mar. 13, 2006, now Pat. No. 7,598,429, and a continuation-in-part of application No. 10/225,067, filed on Aug. 9, 2002, now Pat. No. 7,135,616, and a continuation-in-part of application No. 10/171,468, filed on Jun. 14, 2002, now abandoned, and a continuation-in-part of application No. 09/837,944, filed on Apr. 18, 2001, now abandoned, said application No. 12/169,527 is a continuation-in-part of application No. 11/069,255, filed on Feb. 28, 2005, which is a continuation of application No. 10/112,887, filed on Mar. 18, 2002, now abandoned, said application No. 12/169,527 is a continuation of application No. 10/374,780, filed on Feb. 25, 2003, now Pat. No. 7,511,190, which is a continuation-in-part of application No. 09/934,455, filed on Aug. 22, 2001, now abandoned, and a continuation-in-part of application No. 09/837,944, filed on Apr. 18, 2001, now abandoned, which is a continuation-in-part of application No. 09/713,994, filed on Nov. 16, 2000, now abandoned, said application No. 10/374,780 is a continuation-in-part of application No. 10/225,068, filed on Aug. 9, 2002, now Pat. No. 7,193,129, and a continuation-in-part of application No. 10/171,468, filed on Jun. 14, 2002, now abandoned, and a continuation-in-part of (Continued)

(51) Int. Cl.
*A01H 5/00* (2006.01)
*A01H 5/10* (2006.01)
*C12N 5/14* (2006.01)

(52) U.S. Cl. ...................... 800/298; 800/317.4; 800/295; 435/419

(58) Field of Classification Search ........................ None
See application file for complete search history.

(56) References Cited

U.S. PATENT DOCUMENTS 6,121,513 A 9/2000 Zhang et al.

(Continued)

FOREIGN PATENT DOCUMENTS

EP 1033405 A2 * 6/2000

OTHER PUBLICATIONS

Abbaraju et al. (GenBank Accession No. AF079503.1, Published Aug. 4, 1998).*

(Continued)

*Primary Examiner* — Vinod Kumar
(74) *Attorney, Agent, or Firm* — Cooley LLP

(57) ABSTRACT

The invention relates to plant transcription factor polypeptides, polynucleotides that encode them, homologs from a variety of plant species, and methods of using the polynucleotides and polypeptides to produce transgenic plants having advantageous properties, including increased soluble solids, lycopene, and improved plant volume or yield, as compared to wild-type or control plants. The invention also pertains to expression systems that may be used to regulate these transcription factor polynucleotides, providing constitutive, transient, inducible and tissue-specific regulation.

12 Claims, 3 Drawing Sheets

Figure 1:
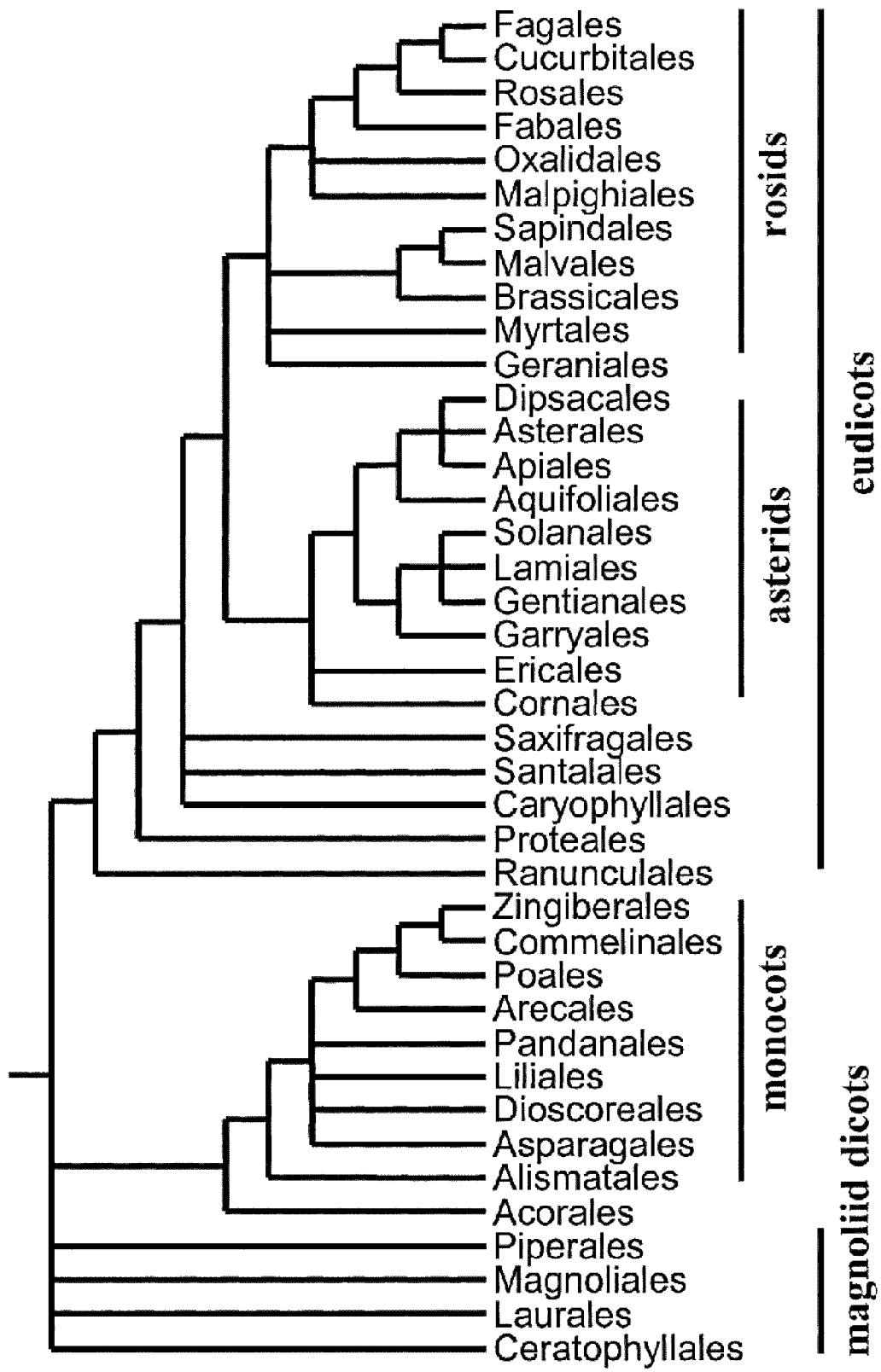

Related U.S. Application Data 60) application No. 09/837,944, filed on Apr. 18, 2001, now abandoned, said application No. 10/374,780 is a continuation-in-part of application No. 10/225,066, filed on Aug. 9, 2002, now Pat. No. 7,238,860, said application No. 10/225,066 is a continuation-in-part of application No. 10/171,468, filed on Jun. 14, 2002, now abandoned, and a continuation-in-part of application No. 09/837,944, filed on Apr. 18, 2001, now abandoned, said application No. 10/374,780 is a continuation-in-part of application No. 10/225,067, filed on Aug. 9, 2002, now Pat. No. 7,135,616, and a continuation-in-part of application No. 10/171,468, filed on Jun. 14, 2002, now abandoned, and a continuation-in-part of application No. 09/837,944, filed on Apr. 18, 2001, now abandoned, application No. 12/169,529, which is a continuation-in-part of application No. 10/546,266, filed as application No. PCT/US2004/05654 on Feb. 25, 2004, now Pat. No. 7,659,446, application No. 12/169,527, which is a continuation-in-part of application No. 11/986,992, filed on Nov. 26, 2007, which is a division of application No. 10/412,699, filed on Apr. 10, 2003, now Pat. No. 7,345,217, which is a continuation-in-part of application No. 10/295,403, filed on Nov. 15, 2002, now abandoned, which is a division of application No. 09/394,519, filed on Sep. 13, 1999, now abandoned, said application No. 10/412,699 is a continuation-in-part of application No. 09/489,376, filed on Jan. 21, 2000, now abandoned, said application No. 10/412,699 is a continuation-in-part of application No. 10/302,267, filed on Nov. 22, 2002, now Pat. No. 7,223,904, which is a division of application No. 09/506,720, filed on Feb. 17, 2000, now abandoned, said application No. 10/412,699 is a continuation-in-part of application No. 10/278,173, filed on Oct. 21, 2002, now abandoned, which is a division of application No. 09/533,392, filed on Mar. 22, 2000, now abandoned, said application No. 10/412,699 is a continuation-in-part of application No. 09/533,029, filed on Mar. 22, 2000, now Pat. No. 6,664,446, said application No. 10/412,699 is a continuation-in-part of application No. 10/278,536, filed on Oct. 22, 2002, now abandoned, which is a division of application No. 09/532,591, filed on Mar. 22, 2000, now abandoned, said application No. 10/412,699 is a continuation-in-part of application No. 09/713,994, filed on Nov. 16, 2000, now abandoned, said application No. 10/412,699 and a continuation-in-part of application No. 09/934,455, filed on Aug. 22, 2001, now abandoned, and a continuation-in-part of application No. 09/837,944, filed on Apr. 18, 2001, now abandoned, is a continuation-in-part of application No. 09/819,142, filed on Mar. 27, 2001, now abandoned, which is a continuation-in-part of application No. 09/713,994, filed on Nov. 16, 2000, now abandoned, said application No. 10/412,699 is a continuation-in-part of application No. 10/225,068, filed on Aug. 9, 2002, now Pat. No. 7,193,129, said application No. 10/225,068 and a continuation-in-part of application No. 10/171,468, filed on Jun. 14, 2002, now abandoned, is a continuation-in-part of application No. 09/837,944, filed on Apr. 18, 2001, now abandoned, said application No. 10/412,699 is a continuation-in-part of application No. 10/225,066, filed on Aug. 9, 2002, now Pat. No. 7,238,860, and a continuation-in-part of application No. 10/171,468, filed on Jun. 14, 2002, now abandoned, and a continuation-in-part of application No. 09/837,944, filed on Apr. 18, 2001, now abandoned, said application No. 10/412,699 is a continuation-in-part of application No. 10/225,067, filed on Aug. 9, 2002, now Pat. No. 7,135,616, and a continuation-in-part of application No. 10/171,468, filed on Jun. 14, 2002, now abandoned, and a continuation-in-part of application No. 09/837,944, filed on Apr. 18, 2001, now abandoned, said application No. 10/412,699 is a continuation-in-part of application No. 10/374,780, filed on Feb. 25, 2003, now Pat. No. 7,511,190, application No. 12/169,527, which is a continuation-in-part of application No. 10/559,441, filed as application No. PCT/US2004/17768 on Jun. 4, 2004, now abandoned, application No. 12/169,527, which is a continuation-in-part of application No. 11/642,814, filed on Dec. 20, 2006, now Pat. No. 7,825,296, which is a division of application No. 10/666,642, filed on Sep. 18, 2003, now Pat. No. 7,196,245, application No. 12/169,527, which is a continuation-in-part of application No. 10/714,887, filed on Nov. 13, 2003, and a continuation-in-part of application No. 10/666,642, filed on Sep. 18, 2003, now Pat. No. 7,196,245, which is a continuation-in-part of application No. 10/456,882, filed on Jun. 6, 2003, now abandoned, application No. 12/169,527, which is a continuation-in-part of application No. 11/435,388, filed on May 15, 2006, now Pat. No. 7,663,025, which is a continuation-in-part of application No. PCT/US2004/37584, filed on Nov. 12, 2004, application No. 12/169,527, which is a continuation-in-part of application No. 11/632,390, filed as application No. PCT/US2005/25010 on Jul. 14, 2005, now abandoned, application No. 12/169,527, which is a continuation-in-part of application No. 12/064,961, filed as application No. PCT/US2006/34615 on Aug. 31, 2006, application No. 12/169,527, which is a continuation-in-part of application No. 10/903,236, filed on Jul. 30, 2004, and a continuation-in-part of application No. 10/666,642, filed on Sep. 18, 2003, now Pat. No. 7,196,245, which is a continuation-in-part of application No. 10/456,882, filed on Jun. 6, 2003, now abandoned, application No. 12/169,527, which is a continuation-in-part of application No. 11/699,973, filed on Jan. 29, 2007, now abandoned, which is a continuation-in-part of application No. PCT/US2005/27151, filed on Jul. 29, 2005, application No. 12/169,527, which is a continuation-in-part of application No. 10/870,198, filed on Jun. 16, 2004, now Pat. No. 7,897,843, said application No. 10/870,198 is a continuation-in-part of application No. 10/669,824, filed on Sep. 23, 2003, which is a continuation-in-part of application No. 09/823,676, filed on Mar. 30, 2001, now Pat. No. 6,717,034, application No. 12/169,527, which is a continuation-in-part of application No. 10/838,616, filed on May 4, 2004, and a continuation-in-part of application No. 10/685,922, filed on Oct. 14, 2003, now abandoned, application No. 12/169,527, which is a continuation-in-part of application No.

PCT/US2007/17321, filed on Aug. 3, 2007, application No. 12/169,527, which is a continuation-in-part of application No. 11/705,903, filed on Feb. 12, 2007, now Pat. No. 7,868,229, which is a continuation-in-part of application No. PCT/US2006/34615, filed on Aug. 31, 2006, application No. 12/169,527, which is a continuation-in-part of application No. 11/821,448, filed on Jun. 22, 2007, now Pat. No. 7,692,067, application No. 12/169,527, which is a continuation-in-part of application No. PCT/US2007/09124, filed on Apr. 12, 2007, application No. 12/169,527, which is a continuation-in-part of application No. 11/981,667, filed on Mar. 7, 2008, and a continuation-in-part of application No. 11/981,576, filed on Oct. 30, 2007, now Pat. No. 7,888,558.

(60) Provisional application No. 60/791,663, filed on Apr. 12, 2006, provisional application No. 60/817,886, filed on Jun. 29, 2006, provisional application No. 60/713,952, filed on Aug. 31, 2005, provisional application No. 60/836,243, filed on Aug. 7, 2006, provisional application No. 60/565,948, filed on Apr. 26, 2004, provisional application No. 60/588,405, filed on Jul. 14, 2004, provisional application No. 60/542,928, filed on Feb. 5, 2004, provisional application No. 60/527,658, filed on Dec. 5, 2003, provisional application No. 60/465,809, filed on Apr. 24, 2003, provisional application No. 60/434,166, filed on Dec. 17, 2002, provisional application No. 60/411,837, filed on Sep. 18, 2002, provisional application No. 60/162,656, filed on Nov. 1, 1999, provisional application No. 60/161,143, filed on Oct. 22, 1999, provisional application No. 60/144,153, filed on Jul. 15, 1999, provisional application No. 60/135,134, filed on May 20, 1999, provisional application No. 60/129,450, filed on Apr. 15, 1999, provisional application No. 60/124,278, filed on Mar. 11, 1999, provisional application No. 60/121,037, filed on Feb. 22, 1999, provisional application No. 60/120,880, filed on Feb. 18, 1999, provisional application No. 60/116,841, filed on Jan. 22, 1999, provisional application No. 60/113,409, filed on Dec. 22, 1998, provisional application No. 60/108,734, filed on Nov. 17, 1998, provisional application No. 60/103,312, filed on Oct. 6, 1998, provisional application No. 60/101,349, filed on Sep. 22, 1998, provisional application No. 60/713,952, filed on Aug. 31, 2005, provisional application No. 60/338,692, filed on Dec. 11, 2001, provisional application No. 60/336,049, filed on Nov. 19, 2001, provisional application No. 60/310,847, filed on Aug. 9, 2001, provisional application No. 60/227,439, filed on Aug. 22, 2000, provisional application No. 60/197,899, filed on Apr. 17, 2000, provisional application No. 60/166,228, filed on Nov. 17, 1999, provisional application No. 60/125,814, filed on Mar. 23, 1999, provisional application No. 60/961,403, filed on Jul. 20, 2007.

(56) References Cited

U.S. PATENT DOCUMENTS

| | | |
|---|---|---|
| 6,946,586 B1 | 9/2005 | Fromm et al. |
| 2002/0142281 A1 | 10/2002 | Broun et al. |
| 2003/0018993 A1 | 1/2003 | Gutterson et al. |
| 2003/0041356 A1 | 2/2003 | Reuber et al. |
| 2003/0046723 A1 | 3/2003 | Heard et al. |
| 2003/0061637 A1 | 3/2003 | Jiang et al. |
| 2003/0093837 A1 | 5/2003 | Keddie et al. |
| 2003/0101481 A1 | 5/2003 | Zhang et al. |
| 2003/0121070 A1 | 6/2003 | Adam et al. |
| 2003/0131386 A1 | 7/2003 | Samaha et al. |
| 2003/0167537 A1 | 9/2003 | Jiang et al. |
| 2003/0188330 A1 | 10/2003 | Heard et al. |
| 2003/0217383 A1 | 11/2003 | Reuber et al. |
| 2003/0226173 A1 | 12/2003 | Ratcliffe et al. |
| 2003/0229915 A1 | 12/2003 | Heard et al. |
| 2004/0019925 A1 | 1/2004 | Heard et al. |
| 2004/0019927 A1 | 1/2004 | Sherman et al. |
| 2004/0045049 A1 | 3/2004 | Zhang et al. |
| 2004/0098764 A1 | 5/2004 | Heard et al. |
| 2004/0128712 A1 | 7/2004 | Jiang et al. |
| 2005/0086718 A1 | 4/2005 | Heard et al. |
| 2005/0097638 A1 | 5/2005 | Jiang et al. |
| 2005/0155117 A1 | 7/2005 | Century et al. |
| 2005/0172364 A1 | 8/2005 | Heard |
| 2006/0008874 A1 | 1/2006 | Creelman et al. |
| 2006/0015972 A1 | 1/2006 | Heard et al. |
| 2006/0162018 A1 | 7/2006 | Gutterson et al. |
| 2006/0195944 A1 | 8/2006 | Heard et al. |
| 2006/0242738 A1 | 10/2006 | Sherman et al. |
| 2006/0272060 A1 | 11/2006 | Heard et al. |
| 2007/0022495 A1* | 1/2007 | Reuber et al. ............... 800/279 |
| 2007/0033671 A1 | 2/2007 | Jiang et al. |
| 2007/0061911 A9* | 3/2007 | Zhang et al. ............... 800/278 |
| 2007/0101454 A1 | 5/2007 | Jiang et al. |
| 2007/0186308 A1 | 8/2007 | Reuber et al. |
| 2007/0199107 A1 | 8/2007 | Ratcliffe et al. |
| 2007/0209086 A1 | 9/2007 | Ratcliffe et al. |
| 2007/0226839 A1 | 9/2007 | Gutterson et al. |
| 2008/0010703 A1 | 1/2008 | Creelman et al. |
| 2008/0155706 A1 | 6/2008 | Riechmann et al. |
| 2008/0163397 A1 | 7/2008 | Ratcliffe et al. |
| 2008/0229448 A1 | 9/2008 | Libby et al. |
| 2008/0301836 A1 | 12/2008 | Century et al. |
| 2008/0301840 A1 | 12/2008 | Gutterson et al. |
| 2008/0301841 A1 | 12/2008 | Ratcliffe et al. |
| 2008/0313756 A1 | 12/2008 | Zhang et al. |
| 2009/0044297 A1* | 2/2009 | Andersen et al. ............ 800/289 |
| 2009/0049566 A1 | 2/2009 | Zhang et al. |
| 2009/0138981 A1* | 5/2009 | Repetti et al. ............... 800/263 |
| 2009/0151015 A1 | 6/2009 | Adam et al. |
| 2009/0192305 A1 | 7/2009 | Riechmann et al. |
| 2009/0205063 A1 | 8/2009 | Zhang et al. |
| 2009/0265807 A1* | 10/2009 | Kumimoto et al. .......... 800/279 |
| 2009/0265813 A1 | 10/2009 | Gutterson et al. |
| 2009/0276912 A1* | 11/2009 | Sherman et al. ............ 800/264 |

OTHER PUBLICATIONS

Valvekens et al. (PNAS, 85:5536-5540, 1998).*
Yanagisawa et al. (Plant Journal, 17:209-214, 1999).*
U.S. Appl. No. 12/526,042, filed Feb. 7, 2008, Repetti, Peter P. et al., Entire document.
U.S. Appl. No. 12/338,024, filed Dec. 18, 2008, Sherman, Bradley et al., Entire document.
U.S. Appl. No. 11/986,992, filed Nov. 26, 2007, Kumimoto, R. et al., entire document.
U.S. Appl. No. 09/394,519, filed Sep. 13, 1999, Zhang, J. et al., Entire document.
U.S. Appl. No. 12/573,311, filed Oct. 5, 2009, Heard, J. et al., Entire document.
U.S. Appl. No. 12/577,662, filed Oct. 12, 2009, Reuber, T. et al., Entire document.
U.S. Appl. No. 12/557,449, filed Sep. 10, 2009, Repetti, P. et al., Entire document.
U.S. Appl. No. 09/627,348, filed Jul. 28, 2000, Thomashow, Michael et al., Entire document.
U.S. Appl. No. 09/489,376, filed Jan. 21, 2000, Heard, J. et al., Entire document.
U.S. Appl. No. 09/489,230, filed Jan. 21, 2000, Broun, P. et al., Entire document.

U.S. Appl. No. 09/506,720, filed Feb. 17, 2000, Keddie, James et al., Entire document.
U.S. Appl. No. 09/533,030, filed Mar. 22, 2000, Keddie, James et al., Entire document.
U.S. Appl. No. 09/533,392, filed Mar. 22, 2000, Jiang, C-Z. et al., Entire document.
U.S. Appl. No. 09/532,591, filed Mar. 22, 2000, Samaha, R. et al., Entire document.
U.S. Appl. No. 09/533,648, filed Mar. 22, 2000, Riechmann, Jose Luis et al., Entire document.
U.S. Appl. No. 10/290,627, filed Nov. 7, 2002, Riechmann, Jose Luis et al., Entire document.
U.S. Appl. No. 09/713,994, filed Nov. 16, 2000, Keddie, James et al., Entire document.
U.S. Appl. No. 09/837,944, filed Apr. 18, 2001, Creelman, Robert et al., Entire document.
U.S. Appl. No. 09/594,214, filed Jun. 14, 2000, Jones, J. et al., Entire document.
U.S. Appl. No. 10/456,882, filed Jun. 6, 2003, Riechmann, Jose Luis et al., Entire document.
U.S. Appl. No. 10/171,468, filed Jun. 14, 2002, Creelman, Robert et al., Entire document.
U.S. Appl. No. 12/376,569, filed Aug. 3, 2007, Creelman, Robert et al., Entire document.
Yanagisawa S (1995) A novel DNA-binding domain that may form a single zinc finger motif Nuc Ac Res 23(17) 3403-3410.
Yanagisawa S (2000) Dof1 and Dof2 transcription factors are associated with expression of multiple genes involved in carbon metabolism Plant J 21(3) 281-288.
Oliver DJ, Raman R (1995) Glycine decarboxylase: protein chemistry and molecular biology of the major protein in leaf mitochondria. Bioenerg Biomembr 27(4):407-14.
Esaka,M., et al.—NCBI acc. No. D45066 (gi: 853689) (Jun. 8, 1995); "Pumpkin mRNA for Ascorbate oxidase promoter-binding protein"; source: Cucurbita maxima (winter squash); Title: (Unpublished (1995)).
Sasaki,T., et al.—NCBI acc. No. AP001383 (gi: 7242897) (Mar. 14, 2000); "Oryza sativa genomic DNA, chromosome 1, clone:P0453A06"; source: Oryza sativa; Title: "Oryza sativa nipponbare(GA3) genomic DNA, chromosome 1, PAC clone:P0453A06" (Published Only in DataBase (2000) In press).
Torrez-Jerez,I., et al.—NCBI acc. No. BF634026 (gi: 11898184) (Dec. 19, 2000); "NF072C11DT1F1085 Drought Medicago truncatula cDNA clone NF072C11DT 5', mRNA sequence"; source: Medicago truncatula (barrel medic); Title: "Expressed Sequence Tags from the Samuel Roberts Noble Foundation Medicago truncatula drought library" (Unpublished (2000)).
Alcala,J., et al.—NCBI acc. No. AW029804 (gi: 5888560) (Sep. 15, 1999); "EST273059 tomato callus, TAMU Solanum lycopersicum cDNA clone cLEC11E11 similar to H-protein promoter binding factor, putative, mRNA sequence"; source: Solanum lycopersicum (Lycopersicon esculentum); Title: "Generation of ESTs from tomato callus tissue" (Unpublished (1999)).
Shoemaker,R., et al.—NCBI acc. No. BG155371 (gi: 12689026) (Feb. 6, 2001); "sab42f05.y1 Gm-c1026 Glycine max cDNA clone Genome Systems Clone ID: Gm-c1026-4473 5' similar to TR:Q39540 Q39540 Ascorbate Oxidase Promoter-Binding Protein, mRNA sequence"; source: Glycine max (soybean); Title: "Public Soybean EST Project" (Unpublished (1999)).
Crookshanks,M., et al.—NCBI acc. No. BI406921 (gi: 15186335) (Aug. 14, 2001); "183H02 Mature tuber lambda ZAP Solanum tuberosum cDNA, mRNA sequence"; source: Solanum tuberosum (potato); Title: "The potato transcriptome: analysis of 6077 expressed sequence tags" (FEBS Lett 506 (2), 123-126 (2001)).
Sato,K., et al.—NCBI acc. No. AV835191 (gi: 14527280) (Jun. 22, 2001); "AV835191 K. Sato unpublished cDNA library: Hordeum vulgare subsp. spontaneum top three leaves adult, heading stage Hordeum vulgare subsp. spontaneum cDNA clone bah26m21, mRNA sequence"; source: Hordeum vulgare subsp. spontaneum; Title: "Barley EST sequencing project in NIG and Okayama Univ" (Unpublished (2001)).
Cordonnier-Pratt,M.-M., et al.—NCBI acc. No. AW671875 (gi: 7535776) (Apr. 11, 2000); "LG1__352__H02.b1__A002 Light Grown 1 (LG1) Sorghum bicolor cDNA, mRNA sequence"; source: Sorghum bicolor (sorghum); Title: "An EST database from Sorghum: light-grown seedlings" (Unpublished (2000)).
Cloutier,S., et al.—NCBI acc. No. BG910120 (gi: 14317796) (Jun. 5, 2001); "TaLr1145G11R TaLr1 Triticum aestivum cDNA clone TaLr1145G11 5', mRNA sequence"; source: Triticum aestivum (bread wheat); Title: "Wheat functional genomics—Thatcher Lr1 cDNA library" (Unpublished (2001)).
Anderson,O.A., et al.—NCBI acc. No. BE421651 (gi: 9419494) (Jul. 24, 2000); "HWM012cD.05r ITEC HWM Barley Leaf Library Hordeum vulgare subsp. vulgare cDNA clone HWM012cD.05, mRNA sequence"; source: Hordeum vulgare subsp. vulgare (domesticated barley); Title: "International Triticeae EST Cooperative (ITEC): Production of Expressed Sequence Tags for Species of the Triticeae" (Unpublished (2000)).
Sasaki,T., et al.—NCBI acc. No. BAA88190 (gi: 6539573) (Dec. 8, 1999); "Similar to H-protein promoter binding factor-2a (AF079503) [Oryza sativa]"; source: Oryza sativa; Title: "Oryza sativa nipponbare(GA3) genomic DNA, chromosome 1, PAC clone:P0038F12" (Published Only in DataBase.
Yamamoto,K., et al. NCBI acc. No. AU056531 (gi: 4715414) (Apr. 29, 1999); "AU056531 Oryza sativa mature leaf Nipponbare Oryza sativa Japonica Group cDNA clone S20663__1A, mRNA sequence"; source: Oryza sativa Japonica Group; Title: "Rice cDNA from mature leaf" (Unpublished (1999)).
Esaka,M., et al.—NCBI acc. No. BAA08094.1 (gi: GI:1669341) (Jun. 8, 1995); "AOBP=Ascorbate oxidase promoter-binding protein"; source: Cucurbita maxima (winter squash); Title: (Unpublished (1995)).
Sasaki,T., et al.—NCBI acc. No. BAA92506 (gi: 7242908) (Mar. 14, 2000); "ESTs C23582(S11122),AU056531(S20663) correspond to a region of the predicted gene.; Similar to AOBP (D45066) [Oryza sativa]"; source: Oryza sativa; Title: "Oryza sativa nipponbare(GA3) genomic DNA, chromosome 1, PAC clone:P0453A06" (Published Only in DataBase (2000) In press).
Vicente-Carbajosa,J., et al.—NCBI acc. No. AAB70119 (gi: 2393775) (Sep. 16, 1997); "prolamin box binding factor [Zea mays]"; source: Zea mays; Title: "A maize zinc-finger protein binds the prolamin box in zein gene promoters and interacts with the basic leucine zipper transcriptional activator Opaque2" (Proc. Natl. Acad. Sci. U.S.A. 94 (14), 7685-7690 (1997)).
Yu,H., et al.—NCBI acc. No. AAC79873 (gi: 3929325) (Nov. 30, 1998); "putative DNA-binding protein [Dendrobium grex Madame Thong-In]"; source: Dendrobium grex Madame Thong-In; Title: "Characterization of genes differentially expressed during orchid floral transiton" (Unpublished).
Mena,M., et al.—NCBI acc. No. (gi: 3777436) (Oct. 21, 1998); "DNA binding protein [Hordeum vulgare]"; source: Hordeum vulgare; Title: "An endosperm-specific DOF protein from barley, highly conserved in wheat, binds to and activates transcription from the prolamin-box of a native B-hordein promoter in barley endosperm" (Plant J. 16, 53-62 (1998)).
Mena,M., et al.—NCBI acc. No. (gi: 3790264) (Oct. 26, 1998); "PBF protein [Triticum aestivum]"; source: Triticum aestivum; Title: "An endosperm-specific DOF protein from barley, highly conserved in wheat, binds to and activates transcription from the prolamin-box of a native B-hordein promoter in barley endosperm" (Plant J. 16, 53-62 (1998)).
Plesch,G., et al.—NCBI acc. No. CAB89831 (gi: 7688355) (May 3, 2000); "Dof zinc finger protein [Solanum tuberosum]"; source: Solanum tuberosum; Title: "Involvement of TAAAG elements suggests a role of Dof transcriptions factors in guard cell-specific gene expression" (Unpublished).
Seki,H., et al.—NCBI acc. No. BAA85655 (gi: 6092016) (Oct. 21, 1999); "elicitor-responsive Dof protein ERDP [Pisum sativum]"; source: Pisum sativum; Title: "Molecular cloning and characterization of a novel elicitor-responsive DNA-binding protein with Dof domain" (Unpublished (1999)).
Baumann,K., et al.—NCBI acc. No. (gi: 3341468) (Jul. 25, 1998); The Dof zinc finger protein NtBBF1 is involved in tissue-specific and auxin-regulated expression of the rolB oncogene in plants.
NCBI acc. No. (gi: 1247386) (Apr. 2, 1996); , et al. "PRP2"; source: Nicotiana alata (Persian tobacco); Title.
Imaizumi et al. 2005 Science 309: 293-297.
U.S. Appl. No. 09/474,435, filed Dec. 28, 1999.

* cited by examiner

PLANT QUALITY WITH VARIOUS PROMOTERS

RELATIONSHIP TO COPENDING APPLICATIONS

This application claims the benefit of Application No. 60/961,403, filed Jul. 20, 2007. This application is a continuation-in-part of application Ser. No. 10/286,264, filed Nov. 1, 2002 (pending), which is a divisional of application Ser. No. 09/533,030, filed Mar. 22, 2000 (abandoned), which claims the benefit of Application No. 60/125,814, filed Mar. 23, 1999. This application is a continuation-in-part of application Ser. No. 10/675,852, filed Sep. 30, 2003 (pending). This application is a continuation-in-part of application Ser. No. 11/479,226, filed Jun. 30, 2006 (pending), which is a continuation-in-part of application Ser. No. 09/713,994, filed Nov. 16, 2000 (abandoned), which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. This application is a continuation-in-part of application Ser. No. 10/669,824, filed Sep. 23, 2003, which is a continuation-in-part of, 09/823,676, filed Mar. 30, 2001 (issued as U.S. Pat. No. 6,717,034). This application is a continuation-in-part of application Ser. No. 11/725,235, filed Mar. 16, 2007, which is a divisional of application Ser. No. 10/225,068, filed Aug. 9, 2002 (issued as U.S. Pat. No. 7,193,129), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 11/728,567, filed Mar. 26, 2007, which is a divisional of application Ser. No. 10/225,066, filed Aug. 9, 2002 (issued as U.S. Pat. No. 7,238,860), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,066 is also a continuation-in-part of application Ser. No. 09/837,944, filed Apr. 18, 2001 (abandoned), and is a continuation-in-part of application Ser. No. 10/171,468, filed Jun. 14, 2002 (abandoned). This application is a continuation-in-part of application Ser. No. 11/375,241, filed Mar. 16, 2006 (pending), which claims the benefit of Application No. 60/713,952, filed Aug. 31, 2005. Application Ser. No. 11/375, 241 is also a continuation-in-part of application Ser. No. 10/225,067, filed Aug. 9, 2002 (issued as U.S. Pat. No. 7,135, 616), which claims the benefit of Application No. 60/310, 847, filed Aug. 9, 2001, which also claims the benefit of Application No. 60/336,049, filed Nov. 19, 2001, and also claims the benefit of Application No. 60/338,692, filed Dec. 11, 2001. Application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 11/069,255, filed Feb. 28, 2005 (pending), which is a continuation-in-part of application Ser. No. 10/112,887, filed Mar. 18, 2002 (abandoned). This application is a continuation-in-part of application Ser. No. 10/374,780, filed Feb. 25, 2003 (pending), which is a continuation-in-part of Application No. 09/934,455, filed Aug. 22, 2001 (abandoned), which is a continuation-in-part of application Ser. Nos. 09/713,994, Nov. 16, 2000 (abandoned), which is also a continuation-in-part of application Ser. No. 09/837,944, filed Apr. 18, 2001 (abandoned), which also claims priority to Application No. 60/227,439, filed Aug. 22, 2000. Application Ser. No. 10/374, 780 is also a continuation-in-part of application Ser. No. 10/225,068, filed Aug. 9, 2002 (issued as U.S. Pat. No. 7,193, 129), which claims the benefit of Application No. 60/310, 847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/374,780 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; application Ser. No. 10/225, 066 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/374,780 is also a continuation-in-part of application Ser. No. 10/225, 067, filed Aug. 9, 2002 (issued as U.S. Pat. No. 7,135,616), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). This application is a continuation-in-part of application Ser. No. 10/546,266, filed Aug. 19, 2005 (pending), which is a '371 National Stage filing of International Application No. PCT/US2004005654, filed Feb. 25, 2004 (converted), which is a continuation-in-part of application Ser. No. 10/374,780, filed Feb. 25, 2003 (pending), and is also a continuation-in-part of application Ser. No. 10/675,852, filed Sep. 30, 2003 (pending). This application is also a continuation-in-part of application Ser. No. 11/986,992, filed Nov. 26, 2007, which is a division of application Ser. No. 10/412,699, filed Apr. 10, 2003 (issued as U.S. Pat. No. 7,345,217), which is a continuation-in-part of application Ser. No. 10/295,403, filed Nov. 15, 2002 (abandoned), which is a divisional of application Ser. No. 09/394, 519, filed Sep. 13, 1999 (abandoned), which claims the benefit of Application No. 60/101,349, filed Sep. 22, 1998, which also claims the benefit of Application No. 60/103,312, filed Oct. 6, 1998, which also claims the benefit of Application No. 60/108,734, filed Nov. 17, 1998, which also claims the benefit of Application No. 60/113,409, filed Dec. 22, 1998. Application Ser. No. 10/412,699 is also a continuation-in-part of application Ser. No. 09/489,376, filed Jan. 21, 2000 (abandoned), which claimed priority to Application No. 60/116, 841, filed Jan. 22, 1999. Application Ser. No. 10/412,699 is also a continuation-in-part of application Ser. No. 10/302, 267, filed Nov. 22, 2002 (issued as U.S. Pat. No. 7,223,904), which is a divisional of application Ser. No. 09/506,720, filed Feb. 17, 2000 (abandoned), which claims the benefit of Application No. 60/120,880, filed Feb. 18, 1999, which also claims the benefit of Application No. 60/121,037, filed Feb. 22, 1999, which also claims the benefit of Application No.

60/124,278, filed Mar. 11, 1999, which also claims the benefit of Application No. 60/129,450, filed Apr. 15, 1999, which also claims the benefit of Application No. 60/135,134, filed May 20, 1999, which also claims the benefit of Application No. 60/144,153, filed Jul. 15, 1999, which also claims the benefit of Application No. 60/161,143, filed Oct. 22, 1999, which also claims the benefit of Application No. 60/162,656, filed Nov. 1, 1999. Application Ser. No. 10/412,699 is also a continuation-in-part of application Ser. No. 10/278,173, filed Oct. 21, 2002 (abandoned), which is a divisional of application Ser. No. 09/533,392, filed Mar. 22, 2000 (abandoned), which claims the benefit of Application No. 60/125,814, filed Mar. 23, 1999. Application Ser. No. 10/412,699 is also a continuation-in-part of application Ser. No. 09/533,029, filed Mar. 22, 2000 (issued as U.S. Pat. No. 6,664,446), which claims the benefit of Application No. 60/125,814, filed Mar. 23, 1999. Application Ser. No. 10/412,699 is also a continuation-in-part of application Ser. No. 10/278,536, filed Oct. 22, 2002 (abandoned), which is a divisional of application Ser. No. 09/532,591, filed Mar. 22, 2000 (abandoned), which claims priority to Application No. 60/125,814, filed Mar. 23, 1999. Application Ser. No. 10/412,699 is also a continuation-in-part of application Ser. No. 09/713,994, filed Nov. 16, 2000 (abandoned), which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. Application Ser. No. 10/412,699 is also a continuation-in-part of application Ser. No. 09/819,142, filed Mar. 27, 2001. Application Ser. No. 10/412,699 is also a continuation-in-part of application Ser. No. 09/934,455, filed Aug. 22, 2001 (abandoned), which is a continuation-in-part of application Ser. No. 09/713,994, filed Nov. 16, 2000 (abandoned), which is also a continuation-in-part of application Ser. No. 09/837,944, filed Apr. 18, 2001 (abandoned), which also claim the benefit of Application No. 60/227,439, filed Aug. 22, 2000. Application Ser. No. 10/412,699 is also a continuation-in-part of application Ser. No. 10/225,068, filed Aug. 9, 2002 (issued as U.S. Pat. No. 7,193,129), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,068 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,066 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,067 is also a continuation-in-part of application Ser. No. 09/837,944, filed Apr. 18, 2001 (abandoned), and is also a continuation-in-part of application Ser. No. 10/171,468, filed Jun. 14, 2002 (abandoned). Application Ser. No. 10/412,699 is also a continuation-in-part of application Ser. No. 10/374,780, filed Feb. 25, 2003 (pending). This application is a continuation-in-part of application Ser. No. 10/559,441, filed Dec. 2, 2005 (pending), which is a '371 National Stage filing of International Application No. PCT/US2004/017768, filed Jun. 4, 2004 (converted), which is a continuation-in-part of application Ser. No. 10/456,882, filed Jun. 6, 2003 (abandoned). This application is a continuation-in-part of application Ser. No. 11/642,814, filed Dec. 20, 2006, which is a divisional of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/434,166, filed Dec. 17, 2002, and also claims the benefit of Application No. 60/465,809, filed Apr. 24, 2003. This application is a continuation-in-part of application Ser. No. 10/714,887, filed Nov. 13, 2003 (pending), which is a continuation-in-part of application Ser. No. 10/456,882, filed Jun. 6, 2003 (abandoned); and application Ser. No. 10/714,887 is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, which also claims the benefit of Application No. 60/434,166, filed Dec. 17, 2002, which also claims the benefit of Application No. 60/465,809, filed Apr. 24, 2003. This application is a continuation-in-part of application Ser. No. 11/435,388, filed May 15, 2006 (pending), which is a continuation-in-part of International Application No. PCT/US04/37584, filed Nov. 12, 2004 (converted), which is a continuation-in-part of application Ser. No. 10/714,887, filed Nov. 13, 2003, and also claims the benefit of Application No. 60/527,658, filed Dec. 5, 2003, and also claims the benefit of Application No. 60/542,928, filed Feb. 5, 2004. This application is a continuation-in-part of application Ser. No. 11/632,390, filed Jan. 11, 2007, which is a '371 National Stage filing of International Application No. PCT/US2005/025010, filed Jul. 14, 2005 (converted), which claims the benefit of Application No. 60/588,405, filed Jul. 14, 2004. This application is a continuation-in-part of application Ser. No. 12/064,961, filed Feb. 26, 2008 (pending), which is a continuation-in-part of PCT application PCT/US06/34615, filed Aug. 31, 2006 (expired), which claims the benefit of Application No. 60/713,952, filed Aug. 31, 2005 (pending). This application is a continuation-in-part of International Application no. PCT/US2006/34615, filed Aug. 31, 2006, which claims the benefit of Application No. 60/713,952, filed Aug. 31, 2005. This application is a continuation-in-part of application Ser. No. 10/903,236, filed Jul. 30, 2004 (pending), which is a continuation-in-part of application Ser. No. 10/456,882, filed Jun. 6, 2003 (abandoned), and is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/465,809, filed Apr. 24, 2003. This application is a continuation-in-part of application Ser. No. 11/699,973, filed Jan. 29, 2007, which is a continuation-in-part of International Application No. PCT/US2005-027151, filed Jul. 29, 2005 (converted), which is a continuation-in-part of application Ser. No. 10/903,236, filed Jul. 30, 2004 (pending). This application is a continuation-in-part of application Ser. No. 10/870,198, filed Jun. 16, 2004 (pending), which claims the benefit of Application No. 60/565,948, filed Apr. 26, 2004, which also claims the benefit of Application No. 60/527,658, filed Dec. 5, 2003, which also claims the benefit of Application No. 60/542,928, filed Feb. 5, 2005; and, Application No. 10/870, 198 is also a continuation-in-part of application Ser. No. 10/669,824, filed Sep. 23, 2003 (pending), which is a continuation-in-part of application Ser. No. 09/823,676, filed Mar. 30, 2001 (issued as U.S. Pat. No. 6,717,034). This application is a continuation-in-part of application Ser. No. 10/838,616, filed May 4, 2004 (pending), which claims the benefit of Application No. 60/565,948, filed Apr. 26, 2004, and is a continuation-in-part of application Ser. No. 10/685,922, filed Oct. 14, 2003 (abandoned). This application is a continuation-in-part of International Application No. PCT/US2007/17321, filed Aug. 7, 2006 (pending), which claims the benefit of Application No. 60/836,243, filed Aug. 7, 2006. This application is a continuation-in-part of application Ser. No. 11/705,903, filed Feb. 12, 2007 (pending), which is a continuation-in-part of International Application No. PCT/US2006/34615, filed Aug. 31, 2006 (converted), which claims the benefit of Application No. 60/713,952, filed Aug. 31, 2005. This application is a continuation-in-part of application Ser. No. 11/821,448, filed Jun. 22, 2007 (pending), which claims priority to Application No. 60/817,886, filed Jun. 29, 2006. This application is a continuation-in-part of application Ser. No. 11/981,667, filed Oct. 31, 2007 (pending). This application is also a continuation-in-part of application Ser. No. 11/981,576 filed Oct. 31, 2007 (pending). This application is a continuation-in-part of International Application No. PCT/US2007/09124, filed Apr. 12, 2007 (pending), which claims priority to Application No. 60/791,663, filed Apr. 12, 2006. The contents of all applications herein are incorporated by reference in their entirety.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement in effect on or before the date the claimed invention was made.

FIELD OF THE INVENTION

The present invention relates to compositions and methods for transforming plants for the purpose of improving plant traits, including yield and fruit quality.

BACKGROUND OF THE INVENTION

Biotechnological improvement of plants. Biotechnology approaches involving the expression of single transgenes in crops have resulted in the successful commercial introduction of new plant traits, including herbicide (e.g., glyphosate) resistance, insect resistance (expression of *Bacillus thuringiensis* toxins) and virus resistance (overexpression of viral coat proteins). Plant genomics may also be used to achieve control over polygenic traits. Some traits that may be improved, resulting in better yield and crop quality, include:

Increased lycopene levels. Lycopene is a pigment responsible for color of fruits (e.g., the red color of tomatoes). Consumers tend to prefer fruit products with good color, and often specifically buy fruit and fruit products based on lycopene levels.

Lycopene and other carotenoids are also valuable antioxidants. Lycopene is the subject of an increasing number of medical studies that demonstrate its efficacy in preventing certain cancers—including prostate, lung, stomach and breast cancers. Potential impacts also include ultraviolet protection and coronary heard disease prevention.

Increased soluble solids. Increased soluble solids are highly valuable to fruit processors for the production of various products. Grapes, for example, are harvested when soluble solids have reached an appropriate level, and the quality of wine produced from grapes is to a large extent dependent on soluble solid content. Increased soluble solids are also important in the production of tomato paste, sauces and ketchup. Increasing soluble solids in tomatoes increases the value of processed tomato products and decreases processing costs. Savings come from reduced processing time and less energy consumption due to shortened cooking times needed to achieve desired soluble solids levels. A one percent increase in tomato soluble solids may be worth $100 to $200 million to the tomato processing industry.

Fruit Weight. Increased fruit weight, such as the weight of tomato fruit, may directly impact yield when the fruit is the primary crop product. This is true for tomato plants, used as a model system in the present studies, and, generally, other fruit crops.

Control of cellular processes in plants with transcription factors. Strategies for manipulating traits by altering a plant cell's transcription factor content can result in plants and crops with new and/or improved commercially valuable properties. For example, manipulation of the levels of selected transcription factors may result in increased expression of economically useful proteins or biomolecules in plants or improvement in other agriculturally relevant characteristics. Conversely, blocked or reduced expression of a transcription factor may reduce biosynthesis of unwanted compounds or remove an undesirable trait. Therefore, manipulating transcription factor levels in a plant offers tremendous potential in agricultural biotechnology for modifying a plant's traits, including traits that improve a plant's survival, yield and product quality.

SUMMARY OF THE INVENTION

The present invention relates to compositions and methods for modifying the genotype of a plant for the purpose of imparting desirable characteristics, including, but not limited to, yield and/or quality-related traits, and these characteristics may pertain to the fruit of the plant. The method steps include transforming a host plant cell with a DNA construct (such as an expression vector or a plasmid). The DNA construct comprises a polynucleotide that encodes a polypeptide that may regulate transcription. The polynucleotide is homologous to a polynucleotide of the invention provided in the Sequence Listing or Tables 7 or 8.

Once the host plant cell is transformed with the DNA construct, a plant may be regenerated from the transformed host plant cell to produce a plant having the desired yield or quality characteristic. Examples of yield and quality characteristics that may be improved by these method steps include increased fungal disease resistance, increased fruit weight, increased fruit number, increased lycopene, increased soluble solids, reduced fruit softening, increased plant vigor, and increased plant size.

BRIEF DESCRIPTION OF THE SEQUENCE LISTING AND FIGURES

The Sequence Listing provides exemplary polynucleotide and polypeptide sequences of the invention. The traits associated with the use of the sequences are included in the Examples.

The copy of the Sequence Listing, being submitted electronically with this patent application, provided under 37

CFR §1.821-1.825, is a read-only memory computer-readable file in ASCII text format. The Sequence Listing is named "MMBI-0070-2CIP_ST25.txt" and is 16,074 kilobytes in size (measured in MS-WINDOWS). The Sequence Listing file was created on Jun. 20, 2008. The Sequence Listing is herein incorporated by reference in its entirety.

FIG. 1 shows a conservative estimate of phylogenetic relationships among the orders of flowering plants (modified from Angiosperm Phylogeny Group (1998)). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001).

Figure 2:
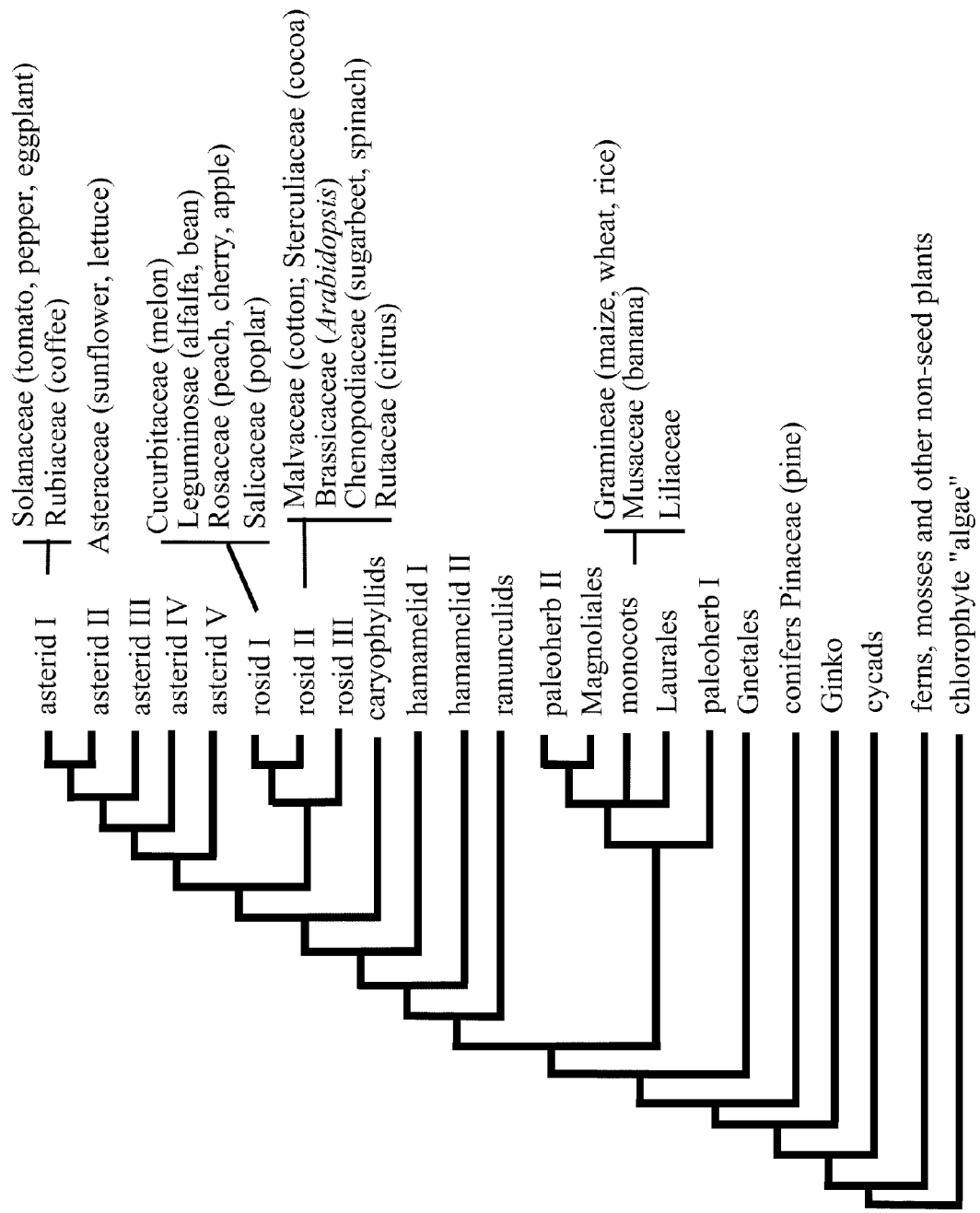

FIG. 2 shows a phylogenic dendogram depicting phylogenetic relationships of higher plant taxa, including clades containing tomato and *Arabidopsis*; adapted from Ku et al. (2000) and Chase et al. (1993).

Figure 3:
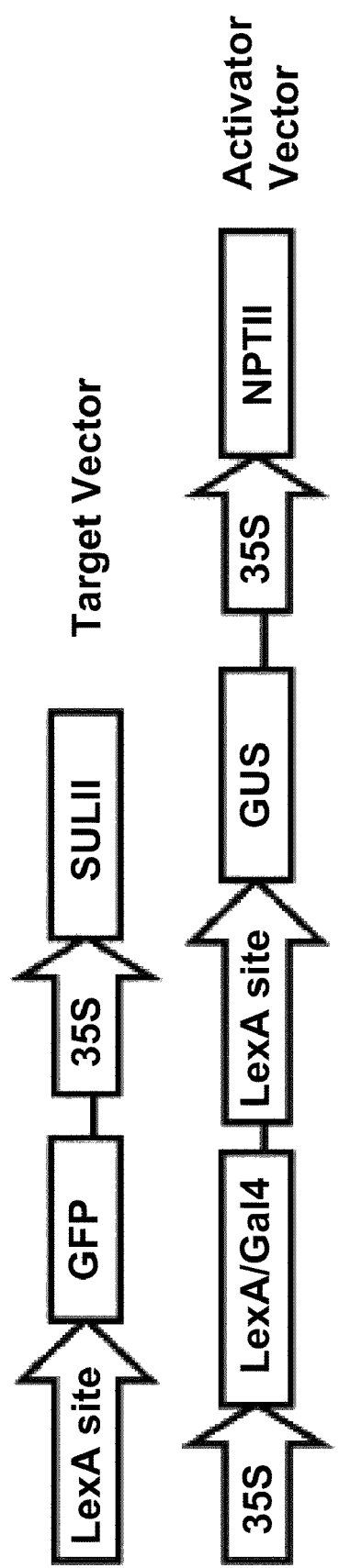

FIG. 3 is a schematic diagram of activator and target vectors used for transformation of tomato to achieve regulated expression of *Arabidopsis* transcription factors in tomato. The activator vector contained a promoter and a LexA-GAL4 or a-LacI-GAL4 transactivator (the transactivator comprises a LexA or LacI DNA binding domain fused to the GAL4 activation domain, and encodes a LexA-Gal4 or LacI-Gal4 transcriptional activator product), a GFP marker, and a neomycin phosphotransferase II (nptII) selectable marker. The target vector contains a transactivator binding site (opLexA) operably linked to a transgene encoding a polypeptide of interest (for example, a transcription factor of the invention), and a sulfonamide selectable marker (in this case, sulII; which encodes the dihydropteroate synthase enzyme for sulfonamide-resistance) necessary for the selection and identification of transformed plants. Binding of the transcriptional activator product encoded by the activator vector to the transactivator binding sites of the target vector initiates transcription of the transgenes of interest.

DESCRIPTION OF THE INVENTION

In an important aspect, the present invention relates to combinations of gene promoters and polynucleotides for modifying phenotypes of plants, including those associated with improved plant or fruit yield, or improved fruit quality. Throughout this disclosure, various information sources are referred to and/or are specifically incorporated. The information sources include scientific journal articles, patent documents, textbooks, and World Wide Web browser-active and inactive page addresses, for example. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

As used herein and in the appended claims, the singular forms "a," "an," and "the" include plural reference unless the context clearly dictates otherwise. Thus, for example, a reference to "a plant" includes a plurality of such plants.

DEFINITIONS

"Polynucleotide" is a nucleic acid molecule comprising a plurality of polymerized nucleotides, e.g., at least about 15 consecutive polymerized nucleotides, optionally at least about 30 consecutive nucleotides, or at least about 50 consecutive nucleotides. A polynucleotide may be a nucleic acid, oligonucleotide, nucleotide, or any fragment thereof of a length listed above. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a polymerase chain reaction (PCR) product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single stranded.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

"Gene" or "gene sequence" refers to the partial or complete coding sequence of a gene, its complement, and its 5' or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as splicing and folding to obtain a functional protein or polypeptide. A gene may be isolated, partially isolated, or be found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and which may be used to determine the limits of the genetically active unit (Rieger et al. (1976)). A gene generally includes regions preceding ("leaders"; upstream) and following ("trailers"; downstream) of the coding region. A gene may also include intervening, non-coding sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

"Complementary" refers to the natural hydrogen bonding by base pairing between purines and pyrimidines. For example, the sequence A-C-G-T (5'->3') forms hydrogen bonds with its complements A-C-G-T (5'->3') or A-C-G-U (5'->3'). Two single-stranded molecules may be considered partially complementary, if only some of the nucleotides bond, or "completely complementary" if all of the nucleotides bond. The degree of complementarity between nucleic acid strands affects the efficiency and strength of the hybridization and amplification reactions. "Fully complementary" refers to the case where bonding occurs between every base pair and its complement in a pair of sequences, notwithstanding gaps that may occur in an alignment due to additional bases in one of the aligned sequences.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985), Sambrook et al. (1989), and by Hames and Higgins (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell knocking out or overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Ectopic expression" or "altered expression" in reference to a polynucleotide indicates that the pattern of expression in, e.g., a transgenic plant or plant tissue, is different from the expression pattern in a wild-type or control plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong promoter (e.g., the cauliflower mosaic virus 35S transcription initiation region). Overexpression may also under the control of an inducible or tissue specific promoter. Thus, overexpression may occur throughout a plant, in specific tissues of the plant, or in the presence or absence of particular environmental signals, depending on the promoter used.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "transcription regulating region" refers to a DNA regulatory sequence that regulates expression of one or more genes in a plant when a transcription factor having one or more specific binding domains binds to the DNA regulatory sequence. Transcription factors of the present invention generally possess at least one conserved domain characteristic of a particular transcription factor family. Examples of such conserved domains of the sequences of the invention may be found in Table 7. The transcription factors of the invention may also comprise an amino acid subsequence that forms a transcription activation domain that regulates expression of one or more abiotic stress tolerance genes in a plant when the transcription factor binds to the regulating region.

"Protein" refers to an amino acid sequence, oligopeptide, peptide, polypeptide or portions thereof whether naturally occurring or synthetic.

A "polypeptide" is an amino acid sequence comprising a plurality of consecutive polymerized amino acid residues e.g., at least about 15 consecutive polymerized amino acid residues, optionally at least about 30 consecutive polymerized amino acid residues, at least about 50 consecutive polymerized amino acid residues. In many instances, a polypeptide comprises a polymerized amino acid residue sequence that is a transcription factor or a domain or portion or fragment thereof. Additionally, the polypeptide may comprise 1) a localization domain, 2) an activation domain, 3) a repression domain, 4) an oligomerization domain, or 5) a DNA-binding domain, or the like. The polypeptide optionally comprises modified amino acid residues, naturally occurring amino acid residues not encoded by a codon, non-naturally occurring amino acid residues.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Homology" refers to sequence similarity between a reference sequence and at least a fragment of a newly sequenced clone insert or its encoded amino acid sequence. Additionally, the terms "homology" and "homologous sequence(s)" may refer to one or more polypeptide sequences that are modified by chemical or enzymatic means. The homologous sequence may be a sequence modified by lipids, sugars, peptides, organic or inorganic compounds, by the use of modified amino acids or the like. Protein modification techniques are illustrated in Ausubel et al. (1998).

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences.

With regard to polypeptides, the terms "substantial identity" or "substantially identical" may refer to sequences of sufficient similarity and structure to the transcription factors in the Sequence Listing to produce similar function when expressed, overexpressed, or knocked-out in a plant; in the present invention, this function is improved yield and/or fruit quality. Polypeptide sequences that are at least about 55% identical to the instant polypeptide sequences are considered to have "substantial identity" with the latter. Sequences having lesser degrees of identity but comparable biological activity are considered to be equivalents. The structure required to maintain proper functionality is related to the tertiary structure of the polypeptide. There are discreet domains and motifs within a transcription factor that must be present within the polypeptide to confer function and specificity. These specific structures are required so that interactive sequences will be properly oriented to retain the desired activity. "Substantial identity" may thus also be used with regard to subsequences, for example, motifs that are of sufficient structure and similarity, being at least about 55% identical to similar motifs in other related sequences. Thus, related polypeptides within the G1421 clade have the physical characteristics of substantial identity along their full length and within their AP2-related domains. These polypeptides also share functional characteristics, as the polypeptides within this clade bind to a transcription-regulating region of DNA and improve yield and/or fruit quality in a plant when the polypeptides are overexpressed.

"Alignment" refers to a number of nucleotide or amino acid residue sequences aligned by lengthwise comparison so that components in common (i.e., nucleotide bases or amino acid residues) may be visually and readily identified. The fraction or percentage of components in common is related to the homology or identity between the sequences. Alignments may be used to identify conserved domains and relatedness within these domains. An alignment may suitably be determined by means of computer programs known in the art, such as MacVector (1999) (Accelrys, Inc., San Diego, Calif.).

A "conserved domain" or "conserved region" as used herein refers to a region in heterologous polynucleotide or polypeptide sequences where there is substantial identity between the distinct sequences. bZIPT2-related domains are examples of conserved domains. With respect to polynucleotides encoding presently disclosed transcription factors, a conserved domain is encoded by a sequence preferably at least 10 base pairs (bp) in length. A conserved domain, with respect to presently disclosed polypeptides refers to a domain within a transcription factor family that exhibits a higher degree of sequence homology or substantial identity, such as at least 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid residue sequence identity to a sequence of consecutive amino acid residues such as SEQ ID NOs 2365-4175. As one of ordinary skill in the art recognizes, conserved domains may be identified as regions or domains of identity to a specific consensus sequence. Thus, by using alignment methods well known in the art, the conserved domains of the plant transcription factors of the invention (e.g., bZIPT2, MYB-related, CCAAT-box binding, AP2, and AT-hook family transcription factors) may be determined. An alignment of any of the polypeptides of the invention with another polypeptide allows one of skill in the art to identify conserved domains for any of the polypeptides listed or referred to in this disclosure.

The terms "paralog" and "ortholog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) World Wide Web (www) website, "tigr.org" under the heading "Terms associated with TIGRFAMs".

The term "variant", as used herein, may refer to polynucleotides or polypeptides that differ from the presently disclosed polynucleotides or polypeptides, respectively, in sequence from each other, and as set forth below.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the terms refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. This, splice variants may encode polypeptides having different amino acid sequences, which may or may not have similar functions in the organism. "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, for example, replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes an conserved domain of a transcription factor. Exemplary fragments also include fragments that comprise a conserved domain of a transcription factor. Exemplary fragments include fragments that comprise a conserved domain of a transcription factor, for example, amino acids: 84-146 of G1421, SEQ ID NO: 180, or 59-150 of G1437, SEQ ID NO: 186, or 9-111 of G663, SEQ ID NO: 1192, or 52-143 of G1957, SEQ ID NO: 446, which comprise, are comprised within, or approximate, the AP2 DNA binding domain, the QLQ/WRC protein interaction/putative DNA binding domains, the SANT/Myb DNA binding domain, or the B3 DNA binding domain of these polypeptides, respectively.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as three amino acid residues to the full length of the intact polypeptide, but are preferably at least about 30 amino acid residues in length and more preferably at least about 60 amino acid residues in length.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like) and cells for example, guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae (see for example, FIG. 1, adapted from Daly et al. (2001); FIG. 2, adapted from Ku et al. (2000); and see also Tudge (2000).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the controlled expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a transcription factor expression is altered, e.g., in that it has been knocked out, overexpressed, or ectopically expressed.

A "control plant" as used in the present invention refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present invention that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring tolerance to water deprivation or particular salt or sugar concentrations, or by the observation of the expression level of a gene or genes, e.g., by employing Northern analysis, RT-PCR, microarray gene expression assays, or reporter gene expression systems, or by agricultural observations such as osmotic stress tolerance or yield. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease, or an even greater difference, in an observed trait as compared with a control or wild-type plant. It is known that there can be a natural variation in the modified trait. Therefore, the trait modification observed entails a change of the normal distribution and magnitude of the trait in the plants as compared to control or wild-type plants.

DETAILED DESCRIPTION

Generally, the polypeptides encoded by the present polynucleotide sequences are involved in cell differentiation, proliferation, and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to improved yield and/or fruit quality. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semi-synthetic or recombinant. The sequences of the invention may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, for example, mutation reactions, PCR reactions, or the like; as substrates for cloning for example, including digestion or ligation reactions; and for identifying exogenous or endogenous modulators of the transcription factors. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, for example, genomic DNA or RNA, a transcript (such as an mRNA), a cDNA, a PCR product, a cloned DNA, a synthetic DNA or RNA, or the like. The polynucleotide can comprise a sequence in either sense or antisense orientations. Expression of genes that encode transcription factors and other regulatory proteins that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) and Peng et al. (1999). In addition, many others have demonstrated that an *Arabidopsis* transcription factor expressed in an exogenous plant species elicits the same or very similar phenotypic response (see, for example, Fu et al. (2001); Nandi et al. (2000); Coupland (1995); and Weigel and Nilsson (1995)).

In another example, Mandel et al. (1992b) and Suzuki et al. (2001) teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992b); Suzuki et al. (2001)).

Other examples include Müller et al. (2001); Kim et al. (2001); Kyozuka and Shimamoto (2002); Boss and Thomas (2002); He et al. (2000); and Robson et al. (2001).

In yet another example, Gilmour et al. (1998) teach an *Arabidopsis* AP2 transcription factor, CBF1, which, when overexpressed in transgenic plants, increases plant freezing tolerance. Jaglo et al. (2001) further identified sequences in *Brassica napus* that encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues which bracket the AP2/EREBP DNA binding domains of the proteins and distinguish them from other members of the AP2/EREBP protein family (Jaglo et al. (2001).

Transcription factors mediate cellular responses and control traits through altered expression of genes containing cis-acting nucleotide sequences that are targets of the introduced transcription factor. It is well appreciated in the art that the effect of a transcription factor on cellular responses or a cellular trait is determined by the particular genes whose expression is either directly or indirectly (for example, by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene and other genes in the MYB family have been shown to control anthocyanin biosynthesis through regulation of the expression of genes known to be involved in the anthocyanin biosynthetic pathway (Bruce et al. (2000); Borevitz et al. (2000)). Further, global transcript profiles have been used successfully as diagnostic tools for specific cellular states (for example, cancerous vs. non-cancerous; Bhattacharjee et al. (2001); Xu et al. (2001)). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors, and transcription factor homolog polypeptides, and isolated or recombinant polynucleotides encoding the polypeptides, or novel sequence variant polypeptides or polynucleotides encoding novel variants of transcription factors derived from the specific sequences provided here.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants. These polypeptides and polynucleotides may be employed to modify a plant's characteristics, particularly improvement of yield and/or fruit quality. The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants. The polypeptide sequences of the sequence listing, including *Ara*- bidopsis sequences, such as those in Table 7, conferred improved characteristics when these polypeptides were overexpressed in tomato plants. These polynucleotides have been shown to confer increased lycopene levels and/or increased soluble solids, which impacts fruit quality, and/or increased fruit weight, which positively impacts fruit yield. Paralogs and orthologs of these sequences, listed herein, are expected to function in a similar manner by increasing these positive effects on fruit quality and/or yield.

The invention also encompasses sequences that are complementary to the polynucleotides of the invention. The polynucleotides are also useful for screening libraries of molecules or compounds for specific binding and for creating transgenic plants having improved yield and/or fruit quality. Altering the expression levels of equivalogs of these sequences, including paralogs and orthologs in the Sequence Listing, and other orthologs that are structurally and sequentially similar to the former orthologs, has been shown and is expected to confer similar phenotypes, including improved biomass, yield and/or fruit quality in plants.

In some cases, exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end PCR using primers specific to the isolated 5' and 3' ends. Exemplary sequences are provided in the Sequence Listing.

The invention also entails an agronomic composition comprising a polynucleotide of the invention in conjunction with a suitable carrier and a method for altering a plant's trait using the composition.

Examples of specific polynucleotide and polypeptides of the invention, and equivalog sequences, along with descriptions of the gene families that comprise these polynucleotides and polypeptides, are provided in Table 7, in the Sequence Listing, and in the description provided below.

Homologous Sequences

Sequences homologous, i.e., that share significant sequence identity or similarity, to those provided in the Sequence Listing, derived from *Arabidopsis thaliana* or from other plants of choice, are also an aspect of the invention. Homologous sequences can be derived from any plant including monocots and dicots and in particular agriculturally important plant species, including but not limited to, grasses such as *Miscanthus*, switchgrass, and sugarcane-*Miscanthus* crosses, and crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; sorghum; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such pine, poplar and eucalyptus, or mint or other labiates. In addition, homologous sequences may be derived from plants that are evolutionarily-related to crop plants, but which may not have yet been used as crop plants. Examples include deadly nightshade (*Atropa belladona*), related to tomato; jimson weed (*Datura strommium*), related to peyote; and teosinte (*Zea* species), the latter being related to corn (maize).

Homologous sequences can comprise orthologous or paralogous sequences, described below. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

Orthologs and Paralogs

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994); Higgins et al. (1996)). Groups of similar genes can also be identified with pair-wise BLAST analysis (Feng and Doolittle (1987)). For example, a clade of very similar MADS domain transcription factors from *Arabidopsis* all share a common function in flowering time (Ratcliffe et al. (2001)), and a group of very similar AP2 domain transcription factors from *Arabidopsis* are involved in tolerance of plants to freezing (Gilmour et al. (1998)). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001))

Transcription factor genes and other regulatory sequences are conserved across diverse eukaryotic species lines (Goodrich et al. (1993); Lin et al. (1991); Sadowski et al. (1988)). Plants are no exception to this observation; diverse plant species possess transcription factors that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994); Higgins et al. (1996)) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

As described by Eisen (1998), evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen (1998)). In fact, many specific examples exist in which gene function has been shown to correlate well with gene phylogeny (Eisen (1998)). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen (1998)).

By using a phylogenetic analysis, one skilled in the art would recognize that the ability to deduce similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct transcription factors, including:

(i) AP2 family *Arabidopsis* G47 (found in U.S. Pat. No. 7,135,616), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication WO2004076638), and numerous phylogenetically-related sequences from eudicots and monocots can confer greater tolerance to drought-related stress as compared to control plants;

(iii) Myb-related *Arabidopsis* G682 (found in U.S. Pat. Nos. 7,223,904 and 7,193,129) and numerous phylogenetically-related sequences from eudicots and monocots can confer greater tolerance to heat, drought-related stress, cold, and salt as compared to control plants;

(iv) WRKY family *Arabidopsis* G1274 (found in U.S. Pat. No. 7,196,245) and numerous closely-related sequences from eudicots and monocots have been shown to confer increased water deprivation tolerance, and (v) AT-hook family soy sequence G3456 (found in US patent publication 20040128712A1) and numerous phylogenetically-related sequences from eudicots and monocots, increased biomass compared to control plants when these sequences are overexpressed in plants.

The polypeptides sequences belong to distinct clades of polypeptides that include members from diverse species. In each case, most or all of the clade member sequences derived from both eudicots and monocots have been shown to confer increased yield or tolerance to one or more abiotic stresses when the sequences were overexpressed. These studies each demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

A method for identifying or confirming that specific homologous sequences control the same function is by comparison of the transcript profile(s) obtained upon overexpression or knockout of two or more related polypeptides. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler and Thomashow (2002), have shown that three paralogous AP2 family genes (CBF1, CBF2 and CBF3) are induced upon cold treatment, and each of which can condition improved freezing tolerance, and all have highly similar transcript profiles. Once a polypeptide has been shown to provide a specific function, its transcript profile becomes a diagnostic tool to determine whether paralogs or orthologs have the same function.

At the polypeptide level, the sequences of the invention will typically share at least about 40%, at least about 41%, at least about 42%, at least about 43%, at least about 44%, at least about 45%, at least about 46%, at least about 47%, at least about 48%, at least about 49%, at least about 50%, at least about 51%, at least about 52%, at least about 53%, at least about 54%, at least about 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid sequence identity, and have similar functions with the polypeptides listed in Table 7 when these sequences are overexpressed in plants.

Of particular interest is the structure of a transcription factor in the region of its conserved domain(s). Structural analyses may be performed by comparing the structure of the known transcription factor around its conserved domain with those of orthologs and paralogs. Analysis of a number of polypeptides within a transcription factor group or clade, including the functionally or sequentially similar polypeptides provided in the Sequence Listing, may also provide an understanding of structural elements required to regulate transcription within a given family. Polypeptides that are phylogenetically related to the polypeptides of Table 7 may also have conserved domains that share at least 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100% amino acid sequence identity, and have similar functions in that the polypeptides of the invention may, when overexpressed in plants, confer at least one regulatory activity and altered trait selected from the group consisting of greater brix, greater fruit weight, greater lycopene, greater biomass, more chlorosis, darker green fruit, darker green leaves, deeper red fruit, larger flowers, larger leaflets, larger leaflets, larger and lighter green leaves, rugulose leaves, more anthocyanin, more trichomes, paler white fruit at the green fruit stage, thicker stems, very high vigor, and waxier leaves, as compared to a control plant.

At the nucleotide level, the sequences of the invention will typically share at least about 30% or 40% nucleotide sequence identity, preferably at least about 50%, 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100%, sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Methods for Determining Sequence Relationships

A variety of methods for determining sequence relationships can be used, including manual alignment and computer assisted sequence alignment and analysis. This later approach is a preferred approach in the present invention, due to the increased throughput afforded by computer assisted methods. As noted below, a variety of computer programs for performing sequence alignment are available, or can be produced by one of skill.

Percent identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp (1988). The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., manually, using the algorithm provided above, or by the Jotun Hein method (see, for example, Hein (1990)). Identity between sequences can also be determined by other methods known in the art, e.g., by varying hybridization conditions (see US Patent Application No. 20010010913).

One example algorithm that is suitable for determining percent sequence identity and sequence similarity is the BLAST algorithm, which is described in Altschul et al. (1990). Software for performing BLAST analyses is publicly available, e.g., through the National Library of Medicine's National Center for Biotechnology Information (ncbi.nlm-.nih; see at world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1993); Altschul et al. (1990)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff (1992)). Unless otherwise indicated, "sequence identity" here refers to the % sequence identity generated from a tblastx using the NCBI version of the algorithm at the default settings using gapped alignments with the filter "off" (see, for example, NIH NLM NCBI website at ncbi.nlm.nih).

In addition to calculating percent sequence identity, the BLAST algorithm also performs a statistical analysis of the similarity between two sequences (see, e.g. Karlin and Altschul (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

Sequence alignment program, include, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Wilmington, Del.) can be searched.

Alignment of sequences for comparison can be conducted by the local homology algorithm of Smith and Waterman (1981), by the homology alignment algorithm of Needleman and Wunsch (1970, by the search for similarity method of Pearson and Lipman (1988), or by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel (2000).

Other techniques for alignment are described by Doolittle (1996). Preferably, an alignment program that permits gaps in the sequence is utilized to align the sequences. The Smith-Waterman is one type of algorithm that permits gaps in sequence alignments (see Shpaer (1997). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

In addition, one or more polynucleotide sequences or one or more polypeptides encoded by the polynucleotide sequences may be used to search against a BLOCKS (Bairoch et al. (1997)), PFAM, and other databases which contain previously identified and annotated motifs, sequences and gene functions. Methods that search for primary sequence patterns with secondary structure gap penalties (Smith et al. (1992)) as well as algorithms such as Basic Local Alignment Search Tool (BLAST; Altschul (1990); Altschul et al. (1993)), BLOCKS (Henikoff and Henikoff (1991)), Hidden Markov Models (HMM; Eddy (1996); Sonnhammer et al. (1997)), and the like, can be used to manipulate and analyze polynucleotide and polypeptide sequences encoded by polynucleotides. These databases, algorithms and other methods are well known in the art and are described in Ausubel et al. (1997), and in Meyers (1995).

Furthermore, methods using manual alignment of sequences similar or homologous to one or more polynucleotide sequences or one or more polypeptides encoded by the polynucleotide sequences may be used to identify regions of similarity and B-box zinc finger domains. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed polypeptides may be cloned using compositions provided by the present invention according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in Table 7 and the Sequence Listing. In addition to the sequences in Table 7 and the Sequence Listing, the invention encompasses isolated nucleotide sequences that are phylogenetically and structurally similar to sequences listed in the Sequence Listing) and can function in a plant by increasing yield and/or and abiotic stress tolerance when ectopically expressed in a plant.

Since a significant number of these sequences are phylogenetically and sequentially related to each other and have been shown to increase yield from a plant and/or abiotic stress tolerance, one skilled in the art would predict that other similar, phylogenetically related sequences falling within the present clades of polypeptides would also perform similar functions when ectopically expressed.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited below (e.g., Sambrook et al. (1989); Berger and Kimmel (1987); and Anderson and Young (1985)).

Encompassed by the invention are polynucleotide sequences that are capable of hybridizing to the claimed polynucleotide sequences, including any of the transcription factor polynucleotides within the Sequence Listing, and fragments thereof under various conditions of stringency (see, for example, Wahl and Berger (1987); and Kimmel (1987)). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989); Berger and Kimmel (1987) pp. 467-469; and Anderson and Young (1985).

Hybridization experiments are generally conducted in a buffer of pH between 6.8 to 7.4, although the rate of hybridization is nearly independent of pH at ionic strengths likely to be used in the hybridization buffer (Anderson and Young (1985)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH.

Hybridization and wash conditions that may be used to bind and remove polynucleotides with less than the desired homology to the nucleic acid sequences or their complements that encode the present transcription factors include, for example:

6×SSC and 1% SDS at 65° C.;
50% formamide, 4×SSC at 42° C.; or
0.5×SSC to 2.0×SSC, 0.1% SDS at 50° C. to 65° C.; or
0.1×SSC to 2×SSC, 0.1% SDS at 50° C.-65° C.;
with a first wash step of, for example, 10 minutes at about 42° C. with about 20% (v/v) formamide in 0.1×SSC, and with, for example, a subsequent wash step with 0.2×SSC and 0.1% SDS at 65° C. for 10, 20 or 30 minutes. An example of a polynucleotide sequence of the invention would thus include a polynucleotide sequence that hybridizes to the complement of any of SEQ ID NO: 2n−1, where n=1 to 1317, or SEQ ID NO: 4176-4823, or SEQ ID NO: 4839 to 10667 under these stringent conditions. Useful variations on these conditions will be readily apparent to those skilled in the art.

A person of skill in the art would not expect substantial variation among polynucleotide species encompassed within the scope of the present invention because the highly stringent conditions set forth in the above formulae yield structurally similar polynucleotides.

For identification of less closely related homologs, wash steps may be performed at a lower temperature, e.g., 50° C. An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Wash procedures will generally employ at least two final wash steps. Additional variations on these conditions will be readily apparent to those skilled in the art (see, for example, U.S. patent application No. 20010010913).

If desired, one may employ wash steps of even greater stringency, including conditions of 65° C.-68° C. in a solution of 15 mM NaCl, 1.5 mM trisodium citrate, and 0.1% SDS, or about 0.2×SSC, 0.1% SDS at 65° C. and washing twice, each wash step of 10, 20 or 30 min in duration, or about 0.1×SSC, 0.1% SDS at 65° C. and washing twice for 10, 20 or 30 min. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C.

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a calorimetric label, a radioactive label, or the like. Labeled hybridization or PCR probes for detecting related polynucleotide sequences may be produced by oligolabeling, nick translation, end-labeling, or PCR amplification using a labeled nucleotide.

Encompassed by the invention are polynucleotide sequences that are capable of hybridizing to the complements of the listed polynucleotide sequences, for example, to SEQ ID NO: 2n−1, where n=1 to 1317 or SEQ ID NO: 4176-4823, or SEQ ID NO: 4839-10667, and fragments thereof under various conditions of stringency (see, e.g., Wahl and Berger (1987); Kimmel (1987)). Estimates of homology are provided by either DNA-DNA or DNA-RNA hybridization under conditions of stringency as is well understood by those skilled in the art (Hames and Higgins (1985). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (e.g., E. coli) and used to raise antibodies (monoclonal or polyclonal) specific for the polypeptide(s) in question. Antibodies can also be raised against synthetic peptides derived from transcription factor, or transcription factor homolog, amino acid sequences. Methods of raising antibodies are well known in the art and are described in Harlow and Lane (1988). Such antibodies can then be used to screen an expression library produced from the plant from which it is desired to clone additional transcription factor homologs, using the methods described above. The selected cDNAs can be confirmed by sequencing and enzymatic activity.

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, for example, DNA or RNA, the latter including mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (e.g., a purification tag, a localization signal, as a fusion-protein, as a pre-protein, or the like), in combination with non-coding sequences (for example, introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, for example, Berger and Kimmel (1987); Sambrook et al. (1989) and Ausubel et al. (1998; supplemented through 2000).

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qβ-replicase amplification and other RNA polymerase mediated techniques (for example, NASBA), e.g., for the production of the homologous nucleic acids of the invention are found in Berger and Kimmel (1987), Sambrook (1989), and Ausubel (2000), as well as Mullis et al. (1990). Improved methods for cloning in vitro amplified nucleic acids are described in U.S. Pat. No. 5,426,039. Improved methods for amplifying large nucleic acids by PCR are summarized in Cheng et al. (1994) and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel (2000), Sambrook (1989) and Berger and Kimmel (1987).

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) and Matthes et al. (1984). According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms that may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G1421, SEQ ID NO: 180, represents a single transcription factor; allelic variation and alternative splicing may be expected to occur. Allelic variants of SEQ ID NO: 179 can be cloned by probing cDNA or genomic libraries from different individual organisms according to standard procedures. Allelic variants of the DNA sequence shown in SEQ ID NO: 179, including those containing silent mutations and those in which mutations result in amino acid sequence changes, are within the scope of the present invention, as are proteins which are allelic variants of SEQ ID NO: 180. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (see U.S. Pat. No. 6,388,064).

Thus, in addition to the sequences set forth in the Sequence Listing, the invention also encompasses related nucleic acid molecules that include allelic or splice variants of the sequences of the invention, for example, SEQ ID NO: 2n−1, where n=1 to 1317, and include sequences that are complementary to any of the above nucleotide sequences. Related nucleic acid molecules also include nucleotide sequences encoding a polypeptide comprising a substitution, modification, addition and/or deletion of one or more amino acid residues compared to the polypeptide sequences of the invention, for example, SEQ ID NO: 2n, where n=1 to 1317, or sequences comprising any of SEQ ID NOs: 2365-4175 or polypeptides encoded by any of SEQ ID NOs: 4839-10667. Such related polypeptides may comprise, for example, additions and/or deletions of one or more N-linked or O-linked glycosylation sites, or an addition and/or a deletion of one or more cysteine residues.

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acid residues in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (1993) or the other methods noted below. Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 1 when it is desired to maintain the activity of the protein. Table 1 shows amino acids which can be substituted for an amino acid in a protein and which are typically regarded as conservative substitutions.

TABLE 1

Possible conservative amino acid substitutions

| Amino Acid Residue | Conservative substitutions |
| --- | --- |
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

The sequences provided in the Sequence Listing or in Table 7 have a novel activity, being plant transcription sequences that may be used to regulate expression of proteins. Although all conservative amino acid substitutions (for example, one basic amino acid substituted for another basic amino acid) in the protein of the invention will not necessarily result in a protein that has transcriptional regulatory activity, it is expected that many of these conservative mutations would result in a protein having transcriptional regulatory activity. Most mutations, conservative or non-conservative, made to a protein of the invention, but outside of a domain critical to the activity of the protein (for example, conserved domains of SEQ ID NOs: 2365-4175) and outside of other domains essential for protein activity, will not affect the activity of the protein to any great extent.

Similar substitutions are those in which at least one residue in the amino acid sequence has been removed and a different residue inserted in its place. Substitutions that are less conservative can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. The modified sequences may be created using purified natural polynucleotides isolated from any organism or may be synthesized from purified compositions and chemicals using chemical means well know to those of skill in the art. For example, Ausubel (2000), provides additional details on mutagenesis methods. Artificial forced evolution methods are described, for example, by Stemmer (1994a), Stemmer (1994b), and U.S. Pat. Nos. 5,811,238, 5,837,500, and 6,242,568. Methods for engineering synthetic transcription factors and other polypeptides are described, for example, by Zhang et al. (2000), Liu et al. (2001), and Isalan et al. (2001). Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel (2000). Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for Saccharomyces cerevisiae and mammals are TAA and TGA, respectively. The preferred stop codon for monocotyledonous plants is TGA, whereas insects and E. coli prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998); Aoyama et al. (1995)), peptides derived from bacterial sequences (Ma and Ptashne (1987)) and synthetic peptides (Giniger and Ptashne (1987)).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene, such as a gene that improves plant and/or fruit quality and/or yield. Preferably, the mRNA expression level will be at least three-fold greater than that of the parental plant, or more preferably at least ten-fold greater mRNA levels compared to said parental plant, and most preferably at least fifty-fold greater compared to said parental plant.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Protein Factors

A transcription factor provided by the present invention can also be used to identify additional endogenous or exogenous molecules that can affect a phenotype or trait of interest. Such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, e.g., a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999)).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. (1991) and is commercially available from Clontech (Palo Alto, Calif.). In such a system, plasmids are constructed that encode two hybrid proteins: one consists of the DNA-binding domain of a transcription activator protein fused to the transcription factor polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the transcription factor protein-protein interactions can be preformed.

Subsequences

Also contemplated are uses of polynucleotides, also referred to herein as oligonucleotides, typically having at least 12 bases, preferably at least 50 bases, which hybridize under stringent conditions to a polynucleotide sequence described above. The polynucleotides may be used as probes, primers, sense and antisense agents, and the like, according to methods as noted above.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook (1989), and Ausubel (2000).

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, e.g., by binding to a specific DNA promoter region an activation domain, or a domain for protein-protein interactions.

Vectors Promoters and Expression Systems

This section describes vectors, promoters, and expression systems that may be used with the present invention. Expression constructs that have been used to transform plants for testing in field trials are also described in Example III. The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger and Kimmel (1987), Sambrook (1989) and Ausubel (2000). Any of the identified sequences can be incorporated into a cassette or vector, e.g., for expression in plants. A number of expression vectors suitable for stable transformation of plant cells or for the establishment of transgenic plants have been described including those described in Weissbach and Weissbach (1989) and Gelvin et al. (1990). Specific examples include those derived from a Ti plasmid of *Agrobacterium tumefaciens*, as well as those disclosed by Herrera-Estrella et al. (1983), Bevan (1984), and Klee (1985) for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) and corn (Gordon-Kamm (1990) can be produced. An immature embryo can also be a good target tissue for monocots for direct DNA delivery techniques by using the particle gun (Weeks et al. (1993); Vasil (1993a); Wan and Lemeaux (1994), and for *Agrobacterium*-mediated DNA transfer (Ishida et al. (1996)).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally—or developmentally—regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 KB of the start of translation, or within 1.5 KB of the start of translation, frequently within 1.0 KB of the start of translation, and sometimes within 0.5 KB of the start of translation.

The promoter sequences can be isolated according to methods known to one skilled in the art.

Examples of constitutive plant promoters which can be useful for expressing the transcription factor sequence include: the cauliflower mosaic virus (CaMV) 35S promoter, which confers constitutive, high-level expression in most plant tissues (see, e.g., Odell et al. (1985)); the nopaline synthase promoter (An et al. (1988)); and the octopine synthase promoter (Fromm et al. (1989)).

The transcription factors of the invention may be operably linked with a specific promoter that causes the transcription factor to be expressed in response to environmental, tissue-specific or temporal signals. A variety of plant gene promoters that regulate gene expression in response to environmental, hormonal, chemical, developmental signals, and in a tissue-active manner can be used for regulating the expression of a polypeptide sequence of the invention in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988)), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998)), flower-specific (Kaiser et al. (1995)), pollen (Baerson et al. (1994)), carpels (Ohl et al. (1990)), pollen and ovules (Baerson et al. (1993)), auxin-inducible promoters (such as that described in van der Kop et al. (1999) or Baumann et al. (1999)), cytokinin-inducible promoter (Guevara-Garcia (1998)), promoters responsive to gibberellin (Shi et al. (1998), Willmott et al. (1998)) and the like. Additional promoters are those that elicit expression in response to heat (Ainley et al. (1993)), light (e.g., the pea rbcS-3A promoter, Kuhlemeier et al. (1989)), and the maize rbcS promoter, Schaffner and Sheen (1991)); wounding (e.g., wun1, Siebertz et al. (1989)); pathogens (such as the PR-1 promoter described in Buchel et al. (1999) and the PDF1.2 promoter described in Manners et al. (1998), and chemicals such as methyl jasmonate or salicylic acid (Gatz (1997)). In addition, the timing of the expression can be controlled by using promoters such as those acting at senescence (Gan and Amasino (1995)); or late seed development (Odell et al. (1994)).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook (1989) and Ausubel (2000).

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985)), infection by viral vectors such as cauliflower mosaic virus (CaMV) (Hohn et al. (1982); U.S. Pat. No. 4,407,956), high velocity ballistic penetration by small particles with the nucleic acid either within the matrix of small beads or particles, or on the surface (Klein et al. (1987)), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984); Fraley et al. (1983)).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Potential Applications of the Presently Disclosed Sequences that Improve Plant Yield and/or Fruit Yield or Quality The genes identified by the experiment presently disclosed represent potential regulators of plant yield and/or fruit yield or quality. As such, these sequences, or their functional equivalogs, orthologs or paralogs, can be introduced into plant species, including commercial plant species, in order to produce higher yield and/or quality, including higher fruit yield and/or quality.

Production of Transgenic Plants and Modification of Traits

The polynucleotides of the invention are favorably employed to produce transgenic plants with various traits, or characteristics, that have been modified in a desirable manner, e.g., to improve the fruit quality characteristics of a plant. For example, alteration of expression levels or patterns (e.g., spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

Homologous Genes Introduced into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Genes, Traits and Utilities that Affect Plant Characteristics

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Antisense and Co-Suppression

In addition to expression of the nucleic acids of the invention as gene replacement or plant phenotype modification nucleic acids, the nucleic acids are also useful for sense and anti-sense suppression of expression, e.g. to down-regulate expression of a nucleic acid of the invention, e.g. as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g. as set forth in Lichtenstein and Nellen (1997). Antisense regulation is also described in Crowley et al. (1985); Rosenberg et al. (1985); Preiss et al. (1985); Melton (1985); Izant and Weintraub (1985); and Kim and Wold (1985). Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988); Smith et al. (1990)). In general, sense or anti-sense sequences are introduced into a cell, where they are optionally amplified, e.g. by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, e.g., to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full-length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using RNA interference, or RNAi. RNAi is a post-transcriptional, targeted gene-silencing technique that uses double-stranded RNA (dsRNA) to incite degradation of messenger RNA (mRNA) containing the same sequence as the dsRNA (Constans (2002)). Small interfering RNAs, or siRNAs are produced in at least two steps: an endogenous ribonuclease cleaves longer dsRNA into shorter, 21-23 nucleotide-long RNAs. The siRNA segments then mediate the degradation of the target mRNA (Zamore (2001). RNAi has been used for gene function determination in a manner similar to antisense oligonucleotides (Constans (2002)). Expression vectors that continually express siRNAs in transiently and stably transfected have been engineered to express small hairpin RNAs (shRNAs), which get processed in vivo into siRNAs-like molecules capable of carrying out gene-specific silencing (Brummelkamp et al. (2002), and Paddison, et al. (2002)). Post-transcriptional gene silencing by double-stranded RNA is discussed in further detail by Hammond et al. (2001), Fire et al. (1998) and Timmons and Fire (1998). Vectors in which RNA encoded by a transcription factor or transcription factor homolog cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999)). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (see for example Koncz et al. (1992a, 1992b)).

Alternatively, a plant phenotype can be altered by eliminating an endogenous gene, such as a transcription factor or transcription factor homolog, e.g., by homologous recombination (Kempin et al. (1997)).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997); Kakimoto et al. (1996)). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (see, e.g., PCT Publications WO 96/06166 and WO 98/53057 which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledonous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al. (1984); Shimamoto et al. (1989); Fromm et al. (1990); and Vasil et al. (1990).

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified using methods well known in the art that are specifically directed to improved fruit or yield characteristics. Methods that may be used are provided in Examples II through VI. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Methods for Increasing Plant Yield or Quality by Modifying Transcription Factor Expression The present invention includes compositions and methods for increasing the yield and quality of a plant or its products, including those derived from a crop plant. These methods incorporate steps described in the Examples listed below, and may be achieved by inserting a nucleic acid sequence of the invention into the genome of a plant cell: (i) a promoter that functions in the cell; and (ii) a nucleic acid sequence that is substantially identical to any of SEQ ID NO: 2n−1, where n=1 to 1317, or SEQ ID NO: 4839-10667, where the promoter is operably linked to the nucleic acid sequence. A transformed plant may then be generated from the cell. One may either obtain transformed seeds from that plant or its progeny, or propagate the transformed plant asexually. Alternatively, the transformed plant may be grown and harvested for plant products directly.

The methods encompassed by the invention may be extended to propagation techniques used to generate plants. For example, a target plant is transformed with a polynucleotide encoding provided in the Sequence Listing, or a polynucleotide encoding a polypeptide that is an equivalog of one of the polypeptides provided in the Sequence Listing, and that has an improved trait relative to a control plant such as one or more traits provided in Table 7, and the transformed target plant may be "selfed" (i.e., self-pollinated) or crossed with another plant to produce transgenic seed. A progeny plant may be grown from this seed, thus generating a transformed progeny plant with the improved trait as compared to the control plant.

EXAMPLES

It is to be understood that this invention is not limited to the particular devices, machines, materials and methods described. Although particular embodiments are described, equivalent embodiments may be used to practice the invention.

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

Example I

Isolation and Cloning of Full-Length Plant Transcription Factor cDNAs

Putative transcription factor sequences (genomic or ESTs) related to known transcription factors were identified in the *Arabidopsis thaliana* GenBank database using the tblastn sequence analysis program using default parameters and a P-value cutoff threshold of B4 or B5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 600 C) and labeled with $^{32}$P dCTP using the High Prime DNA Labeling Kit (Roche Diagnostics Corp., Indianapolis, Ind.). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Strategy to Produce a Tomato Population Expressing all Transcription Factors Driven by Various Promoters Ten promoters were chosen to control the expression of transcription factors in tomato for the purpose of evaluating complex traits in fruit development. All ten are expressed in fruit tissues, although the temporal and spatial expression patterns in the fruit vary (Table 2). All of the promoters have been characterized in tomato using a LexA-GAL4 two-component activation system. The PID (Plasmid IDentifier) and PID SEQ ID NOs used in the field study to drive expression of the sequences of the invention are listed in the second column.

TABLE 2

Promoters, promoter constructs and expression patterns used in the field study

| Promoter | PID and SEQ ID NO: of promoter construct | General expression patterns | References |
|---|---|---|---|
| CaMV35S ("35S") | P6506 SEQ ID NO: 4837 | Constitutive, high levels of expression in all throughout the plant and fruit | Odell et al (1985) |
| SHOOT MERISTEMLESS (STM) | P5318 SEQ ID NO: 4832 | Expressed in meristematic tissues, including apical meristems, cambium. Low levels of expression also in some differentiating tissues. In fruit, most strongly expressed in vascular tissues and endosperm. | Long and Barton (1998) Long and Barton (2000) |
| ASYMMETRIC LEAVES 1 (AS1) | P5319 SEQ ID NO: 4833 | Expressed predominately in differentiating tissues. In fruit, most strongly expressed in vascular tissues and in endosperm. | Byrne et al (2000) Ori et al. (2000) |
| LIPID TRANSFER PROTEIN 1 (LTP1) | P5287 SEQ ID NO: 4825 | In vegetative tissues, expression predominately in epidermis. Low levels of expression also evident in vascular tissue. In fruit, expression is strongest in the pith-like columella/placental tissue. | Thoma et al. (1994) |
| RIBULOSE-1,5-BISPHOSPHATE CARBOXYLASE, SMALL SUBUNIT 3 (RbcS3) | P5284 SEQ ID NO: 4824 | Expression predominately in highly photosynthetic vegetative tissues. Fruit expression predominately in the pericarp. | Wanner and Gruissem (1991) |
| ROOT SYSTEM INDUCIBLE 1 (RSI-1) | P5310 SEQ ID NO: 4830 | Expression generally limited to roots. Also expressed in the vascular tissues of the fruit. | Taylor and Scheuring (1994) |
| APETALA 1 (AP1) | P5326 SEQ ID NO: 4835 | Light expression in leaves increases with maturation. Highest expression in flower primordia and flower organs. In fruits, predominately in pith-like columella/placental tissue. | Mandel et al. (1992a) Hempel et al. (1997) |
| POLYGALACTURONASE (PG) | P5297 SEQ ID NO: 4828 | High expression throughout the fruit, comparable to 35S. Strongest late in fruit development. | Nicholass et al. (1995) Montgomery et al. (1993) |
| PHYTOENE DESATURASE (PD) | P5303 SEQ ID NO: 4829 | Moderate expression in fruit tissues. | Corona et al. (1996) |
| CRUCIFERIN 1 (Cru) | P5324 SEQ ID NO: 4834 | Expressed at low levels in fruit vascular tissue and columella, endosperm expression. | Breen and Crouch (1992) Sjodahl et al. (1995) |

Transgenic tomato lines expressing all *Arabidopsis* transcription factors driven by ten tissue and/or developmentally regulated promoters relied on the use of a two-component system similar to that developed by Guyer et al. (1998) that uses the DNA binding domain of the yeast GAL4 transcriptional activator fused to the activation domains of the maize C1 or the herpes simplex virus VP16 transcriptional activators, respectively. Modifications used either the *E. coli* lactose repressor DNA binding domain (LacI) or the *E. coli* LexA DNA binding domain fused to the GAL4 activation domain. The LexA-based system was the most reliable in activating tissue-specific GFP expression in tomato and was used to generate the tomato population. A diagram of the test transformation vectors is shown in FIG. 3. *Arabidopsis* transcription factor genes replaced the GFP gene in the target vector. As shown in Table 7, various promoters were used in the activator plasmid. Both families of vectors were used to transform tomato to yield one set of transgenic lines harboring different target vector constructs of transcription factor genes and a second population harboring the activator vector constructs of promoter-LexA/GAL4 fusions. Transgenic plants harboring the activator vector construct of promoter-LexA/GAL4 fusions were screened to identify plants with appropriate and high level expression of GUS. In addition, five of each of the transgenic plants harboring the target vector constructs of transcription factor genes were grown and crossed with a 35S activator line. F1 progeny were assayed to ensure that the transgene was capable of being activated by the LexA/GAL4 activator protein. The best plants constitutively expressing transcription factors were selected for subsequent crossing to the ten transgenic activator lines. Several of these initial lines have been evaluated and preliminary results of seedling traits indicate that similar phenotypes observed in *Arabidopsis* were also observed in tomato when the same transcription factor was constitutively overexpressed. Thus, each parental line harboring either a promoter-LexA/GAL4 activator or an activatible *Arabidopsis* transcription factors gene were pre-selected based on a functional assessment. These parental lines were used in sexual crosses to generate F1 (hemizygous for the activator and target genes) lines representing the complete set of *Arabidopsis* transcription factors under the regulation of the promoter. The transgenic tomato population was grown field conditions for evaluation.

Example III

Test Constructs

The Two-Component Multiplication System vectors have an activator vector and a target vector. The LexA version of these is shown in FIG. 3. The LacI versions are identical except that LacI replaces LexA portions. Both LacI and LexA DNA binding regions were tested in otherwise identical vectors. These regions were made from portions of the test vectors described above, using standard cloning methods. They were cloned into a binary vector that had been previously tested in tomato transformations. These vectors were then introduced into *Arabidopsis* and tomato plants to verify their functionality. The LexA-based system was determined to be the most reliable in activating tissue-specific GFP expression in tomato and was used to generate the tomato population.

A useful feature of the PTF Tool Kit vectors described in FIG. 3 is the use of two different resistance markers, one in the activator vector and another in the target vector. This greatly facilitates identifying the activator and target plant transcription factor genes in plants following crosses. The presence of both the activator and target in the same plant can be confirmed by resistance to both markers. Additionally, plants homozygous for one or both genes can be identified by scoring the segregation ratios of resistant progeny. These resistance markers are useful for making the technology easier to use for the breeder.

Another useful feature of the PTF Tool Kit activator vector described in FIG. 3 is the use of a target GFP construct to characterize the expression pattern of each of the 10 activator promoters. The Activator vector contains a construct consisting of multiple copies of the LexA (or LacI) binding sites and a TATA box upstream of the gene encoding the green fluorescence protein (GFP). This GFP reporter construct verifies that the activator gene is functional and that the promoter has the desired expression pattern before extensive plant crossing and characterizations proceed. The GFP reporter gene is also useful in plants derived from crossing the activator and target parents because it provides an easy method to detect the pattern of expression of expressed plant transcription factor genes.

Example IV

Tomato Transformation and Sulfonamide Selection

After the activator and target vectors were constructed, the vectors were used to transform *Agrobacterium tumefaciens* cells. Since the target vector comprised a polypeptide or interest (in the example given in FIG. 3, the polypeptide of interest was green fluorescent protein; other polypeptides of interest may include transcription factor polypeptides of the invention), it was expected that plants containing both vectors would be conferred with improved and useful traits. Methods for generating transformed plants with expression vectors are well known in the art; this Example also describes a novel method for transforming tomato plants with a sulfonamide selection marker. In this Example, tomato cotyledon explants were transformed with *Agrobacterium* cultures comprising target vectors having a sulfonamide selection marker.

Seed sterilization. T63 seeds were surface sterilized in a sterilization solution of 20% bleach (containing 6% sodium hypochlorite) for 20 minutes with constant stirring. Two drops of Tween 20 were added to the sterilization solution as a wetting agent. Seeds were rinsed five times with sterile distilled water, blotted dry with sterile filter paper and transferred to Sigma P4928 phytacons (25 seeds per phytacon) containing 84 ml of MSO medium (the formula for MS medium may be found in Murashige and Skoog (1962); MSO is supplemented as indicated in Table 3).

Seed germination and explanting. Phytacons were placed in a growth room at 24° C. with a 16 hour photoperiod. Seedlings were grown for seven days.

Explanting plates were prepared by placing a 9 cm Whatman No. 2 filter paper onto a plate of 100 mm×25 mm Petri dish containing 25 ml of R1F medium. Tomato seedlings were cut and placed into a 100 mm×25 mm Petri dish containing a 9 cm Whatman No. 2 filter paper and 3 ml of distilled water. Explants were prepared by cutting cotyledons into three pieces. The two proximal pieces were transferred onto the explanting plate, and the distal section was discarded. One hundred twenty explants were placed on each plate. A control plate was also prepared that was not subjected to the *Agrobacterium* transformation procedure. Explants were kept in the dark at 24° C. for 24 hours.

*Agrobacterium* culture preparation and cocultivation. The stock of *Agrobacterium tumefaciens* cells for transformation were made as described by Nagel et al. (1990). *Agrobacterium* strain ABI was grown in 250 ml LB medium (Sigma)

overnight at 28° C. with shaking until an absorbance over 1 cm at 600 nm ($A_{600}$) of 0.5-1.0 was reached. Cells were harvested by centrifugation at 4,000×g for 15 minutes at 4° C. Cells were then resuspended in 250l chilled buffer (1 mM HEPES, pH adjusted to 7.0 with KOH). Cells were centrifuged again as described above and resuspended in 125 μL chilled buffer. Cells were then centrifuged and resuspended two more times in the same HEPES buffer as described above at a volume of 100 μL and 750 μL, respectively. Resuspended cells were then distributed into 40 μL aliquots, quickly frozen in liquid nitrogen, and stored at −80° C.

Agrobacterium cells were transformed with vectors prepared as described above following the protocol described by Nagel et al. (1990). For each DNA construct to be transformed, 50 to 100 ng DNA (generally resuspended in 10 mM Tris-HCl, 1 mM EDTA, pH 8.0) were mixed with 40 μL of Agrobacterium cells. The DNA/cell mixture was then transferred to a chilled cuvette with a 2 mm electrode gap and subject to a 2.5 kV charge dissipated at 25 RF and 200 RF using a Gene Pulser TI apparatus (Bio-Rad, Hercules, Calif.). After electroporation, cells were immediately resuspended in 1.0 ml LB and allowed to recover without antibiotic selection for 2 B 4 hours at 28° C. in a shaking incubator. After recovery, cells were plated onto selective medium of LB broth containing 100 μg/ml spectinomycin (Sigma) and incubated for 24-48 hours at 28° C. Single colonies were then picked and inoculated in fresh medium. The presence of the vector construct was verified by PCR amplification and sequence analysis.

Agrobacteria were cultured in two sequential overnight cultures. On day 1, the agrobacteria containing the target vectors having the sulfonamide selection vector (FIG. 3) were grown in 25 ml of liquid 523 medium (Moore et al. (1988)) plus 100 mg spectinomycin, 50 mg kanamycin, and 25 mg chloramphenicol per liter. On day 2, five ml of the first overnight suspension were added to 25 ml of AB medium to which is added 100 mg spectinomycin, 50 mg kanamycin, and 25 mg chloramphenicol per liter. Cultures were grown at 28° C. with constant shaking on a gyratory shaker. The second overnight suspension was centrifuged in a 38 ml sterile Oakridge tubes for 5 minutes at 8000 rpm in a Beckman JA20 rotor. The pellet was resuspended in 10 ml of MSO liquid medium containing 600 μm acetosyringone (for each 20 ml of MSO medium, 40 μl of 0.3 M stock acetosyringone were added). The Agrobacterium concentration was adjusted to an $A_{600}$ of 0.25.

Seven milliliters of this Agrobacterium suspension were added to each of explanting plates. After 20 minutes, the Agrobacterium suspension was aspirated and the explants were blotted dry three times with sterile filter paper. The plates were sealed with Parafilm® and incubated in the dark at 21° C. for 48 hours.

Regeneration. Cocultivated explants were transferred after 48 hours in the dark to 100 mm×25 mm Petri plates (20 explants per plate) containing 25 ml of R1SB10 medium (this medium and subsequently used media contained sulfadiazine, the sulfonamide antibiotic used to select transformants). Plates were kept in the dark for 72 hours and then placed in low light. After 14 days, the explants were transferred to fresh RZ1/2SB25 medium. After an additional 14 days, the regenerating tissues at the edge of the explants were excised away from the primary explants and were transferred onto fresh RZ1/2SB25 medium. After another 14 day interval, regenerating tissues were again transferred to fresh ROSB25 medium. After this period, the regenerating tissues were subsequently rotated between ROSB25 and RZ1/2SB25 media at two week intervals. The well defined shoots that appeared were excised and transferred to ROSB100 medium for rooting.

Shoot Analysis. Once shoots were rooted on ROSB100 medium, small leaf pieces from the rooted shoots were sampled and analyzed with a polymerase chain reaction procedure (PCR) for the presence of the SulA gene. The PCR-positive shoots (TO) were then grown to maturity in the greenhouses. Some TO plants were crossed to plants containing the CaMV 35S activator vector. The TO self pollinated seeds were saved for later crosses to different activator promoters.

TABLE 3

Media Compositions (amounts per liter)

|  | MSO | R1F | R1SB10 | RZ1/2SB25 | ROSB25 | ROSB100 |
|---|---|---|---|---|---|---|
| Gibco ® MS Salts | 4.3 g | 4.3 g | 4.3 g | 4.3 g | 4.3 g | 4.3 g |
| RO Vitamins (100X) | 10 ml |  |  | 5 ml | 10 ml | 10 ml |
| R1 Vitamins (100X) |  | 10 ml | 10 ml |  |  |  |
| RZ Vitamins (100X) |  |  |  | 5 ml |  |  |
| Glucose | 16.0 g | 16.0 g | 16.0 g | 16.0 g | 16.0 g | 16.0 g |
| Timentin ® |  |  | 100 mg |  |  |  |
| Carbenicillin |  |  |  | 350 mg | 350 mg | 350 mg |
| Noble Agar | 8 | 11.5 | 10.3 | 10.45 | 10.45 | 10.45 |
| MES |  |  | 0.6 g | 0.6 g | 0.6 g | 0.6 g |
| Sulfadiazine free acid (10 mg/ml stock) |  |  | 1 ml | 2.5 ml | 2.5 ml | 10 ml |
| pH | 5.7 | 5.7 | 5.7 | 5.7 | 5.7 | 5.7 |

TABLE 4

100x Vitamins (amounts per liter)

|  | RO | R1 | RZ |
|---|---|---|---|
| Nicotinic acid | 500 mg | 500 mg | 500 mg |
| Thiamine HCl | 50 mg | 50 mg | 50 mg |
| Pyridoxine HCl | 50 mg | 50 mg | 50 mg |
| Myo-inositol | 20 g | 20 g | 20 g |
| Glycine | 200 mg | 200 mg | 200 mg |
| Zeatin |  | 0.65 mg | 0.65 mg |
| IAA |  | 1.0 mg |  |
| pH | 5.7 | 5.7 | 5.7 |

TABLE 5

523 Medium (amounts per liter)

| | |
|---|---|
| Sucrose | 10 g |
| Casein Enzymatic Hydrolysate | 8 g |
| Yeast Extract | 4 g |
| $K_2HPO_4$ | 2 g |
| $MgSO_4 \cdot 7H_2O$ | 0.3 g |
| pH | 7.00 |

TABLE 6

AB Medium

| Part A | | Part B (10X stock) | |
|---|---|---|---|
| $K_2HPO_4$ | 3 g | $MgSO_4 \cdot 7H_2O$ | 3 g |
| $NaH_2PO_4$ | 1 g | $CaCl_2$ | 0.1 g |
| $NH_4Cl$ | 1 g | $FeSO_4 \cdot 7H_2O$ | 0.025 g |
| KCl | 0.15 g | Glucose | 50 g |
| pH | 7.00 | | 7.00 |
| Volume | 900 ml | | 1000 ml |

Prepared by autoclaving and mixing 900 ml Part A with 100 ml Part B.

Example V

Population Characterization and Measurements

After the crosses were made (to generate plants having both activator and target vectors), general characterization of the F1 population was performed in the field. General evaluation included photographs of seedling and adult plant morphology, photographs of leaf shape, open flower morphology and of mature green and ripe fruit. Vegetative plant size, a measure of plant biomass, was measured by ruler at approximately two months after transplant. Plant volume was obtained by the multiplication of the three dimensions. In addition, observations were made to determine fruit number per plant. Three red-ripe fruit were harvested from each individual plant when possible and were used for the lycopene and Brix assays. Two weeks later, six fruits per promoter:: gene grouping were harvested, with two fruits per plant harvested when possible. The fruits were pooled, weighed, and seeds collected.

Measurement of soluble solids. "Brix" measurement was used to determine the amount of sugar in solution. For example, 18 degree Brix sugar solution contains 18% sugar (w/w basis). Brix was measured using a refractometer (which measures refractive index). Brix measurements were performed by the follow protocol:

1. Three red ripe fruit were harvest from each plant sampled.
2. Each sample of three fruit was weighed together
3. The three fruit were then quartered and blended together at high speed in a blender for approximately four minutes, until a fine puree was produced.
4. Two 40 ml aliquots were decanted from the pureed sampled into 50 ml polypropylene tubes.
5. Samples were then kept frozen at −20° C. until analysis
6. For analysis samples were thawed in warm water.
7. Approximately 15 ml of thawed tomato puree was filtered and placed onto the reading surface of a digital refractometer, and the reading recorded.

Fruit lycopene measurements. Lycopene is a pigment responsible for color of fruits (e.g., the red color of tomatoes). It was measured by the following procedure:

1. Three red ripe fruit were harvest from each plant sampled.
2. Each sample of three fruit was weighed together
3. The three fruit were then quartered and blended together at high speed in a blender for approximately four minutes, until a fine puree was produced.
4. Two 40 ml aliquots were decanted from the pureed sampled into 50 ml polypropylene tubes.
5. Samples were frozen at −20° C. until further analysis was performed
6. Samples were thawed in warm water.
7. Lycopene level was measured using high performance liquid chromatography (HPLC).

Source/sink activities. Source/sink activities were determined by screening for lines in which *Arabidopsis* transcription factors were driven by the RbcS-3 (leaf mesophyll expression), LTP1 (epidermis and vascular expression) and the PD (early fruit development) promoters. These promoters target source processes localized in photosynthetically active cells (RbcS-3), sink processes localized in developing fruit (PD) or transport processes active in vascular tissues (LTP1) that link source and sink activities. Leaf punches were collected within one hour of sunrise, in the seventh week after transplant, and stored in ethanol. The leaves were then stained with iodine, and plants with notably high or low levels of starch were noted.

Fruit ripening regulation. Screening for traits associated with fruit ripening focused on transgenic tomato lines in which *Arabidopsis* transcription factors are driven by the PD (early fruit development) and PG (fruit ripening) promoters. These promoters target fruit regulatory processes that lead to fruit maturation or which trigger ripening or components of the ripening process. In order to identify lines expressing transcription factors that impact ripening, fruits at 1 cm stage, a developmental time 7-10 days post anthesis and shortly after fruit set were tagged. Tagging occurred over a single two-day period per field trial at a time when plants are in the early fruiting stage to ensure tagging of one to two fruits per plant, and four to six fruits per line. Tagged fruit at the "breaker" stage on any given inspection were marked with a second colored and dated tag. Later inspections included monitoring of breaker-tagged fruit to identify any that have reached the full red ripe stage. To assess the regulation of components of the ripening process, fruit at the mature green and red ripe stage have been harvested and fruit texture analyzed by force necessary to compress equator of the fruit by 2 mm.

Example VI

Screening CaMV 35S Activator Line Progeny with the Transcription Factor Target Lines to Identify Lines Expressing Plant Transcription Factors The plant transcription factor target plants that were initially prepared lacked an activator gene to facilitate later crosses to various activator promoter lines. In order to find transformants that were adequately expressed in the presence of an activator, the plant transcription factor plants were crossed to the CaMV 35S promoter activator line and screened for transcription factor expression by RT-PCR. The mRNA was reverse transcribed into cDNA and the amount of product was measured by quantitative PCR.

Because the parental lines were each heterozygous for the transgenes, T1 hybrid progeny were sprayed with chlorsulfuron and cyanamide to find the 25% of the progeny containing both the activator (chlorsulfuron resistant) and target (cyanamide resistant) transgenes. Segregation ratios were measured and lines with abnormal ratios were discarded. Too high a ratio indicated multiple inserts, while too low a ratio indicated a variety of possible problems. The ideal inserts produced 50% resistant progeny. Progeny containing both inserts appeared at 25% because they also required the other herbicidal markers from the Activator parental line (50%×50%).

These T1 hybrid progeny were then screened in a 96 well format for plant transcription factor gene expression by RT-PCR to ensure expression of the target plant transcription factor gene, as certain chromosomal positions can be silent or very poorly expressed or the gene can be disrupted during the integration process. The 96 well format was also used for cDNA synthesis and PCR. This procedure involves the use of one primer in the transcribed portion of the vector and a second gene-specific primer.

Because both the activator and target genes are dominant in their effects, phenotypes were observable in hybrid progeny containing both genes. These T1F1 plants were examined for visual phenotypes. However, more detailed analysis for increased color, high solids and disease resistance were also conducted once the best lines were identified and reproduced on a larger scale.

Example VII

Results of Overexpressing Specific Promoter::Transcription Factor Combinations in Tomato Plants Using the methods described in the above Examples, a number of *Arabidopsis* sequences were identified that resulted, when expressed in tomato plants, in greater brix, greater fruit weight, greater lycopene, greater biomass, more chlorosis, darker green fruit, darker green leaves, deeper red fruit, larger flowers, larger leaflets, larger leaflets, larger and lighter green leaves, rugulose leaves, more anthocyanin, more trichomes, paler white fruit at the green fruit stage, thicker stems, very high vigor, and/or waxier leaves, as compared to a control plant. Table 7 shows a number of polypeptides of the invention shown to improve fruit or yield characteristics. SEQ ID NOs and GID (Gene IDentifiers) are listed in Columns 1 and 2. The conserved domains in amino acid coordinates (beginning from the n-terminus of each polypeptide) of each polypeptide associates with particular Transcription Factor Family, and the Transcription Factor Families to which the polypeptide belongs, are listed in Columns 3 and 4, respectively. The PID (Plasmid IDentifier) and PID SEQ ID NOs are listed in Columns 5 and 6, respectively. The promoters used to drive expression of the polynucleotides encoding the polypeptides and the traits that were observed in tomato plants when each polypeptide sequence was overexpressed in tomato plants, relative to traits observed in control tomato plants, are listed in Column 7. Sequences listed below for the traits of increased lycopene, brix and fruit weight were in the top 5% of all tomato lycopene, brix and fruit weight measurements, respectively.

TABLE 7

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2 | 464 | AP2 (129-195, 221-288) | P5310 (root-expressed RSI1 prom.) | P8197 | 4657 | Inc. brix |
| G2 | 464 | AP2 (129-195, 221-288) | P5284 (leaf-expressed RbcS3 prom.) | P8197 | 4657 | Inc. lycopene |
| G2 | 464 | AP2 (129-195, 221-288) | P5310 (root-expressed RSI1 prom.) | P8197 | 4657 | Inc. lycopene |
| G3 | 944 | AP2 (28-95) | P5284 (leaf-expressed RbcS3 prom.) | P3375 | 4181 | Inc. lycopene |
| G3 | 944 | AP2 (28-95) | P5326 (floral meristem-expressed AP1 prom.) | P3375 | 4181 | Inc. lycopene |
| G4 | 1054 | AP2 (121-183) | P5326 (floral meristem-expressed AP1 prom.) | P7794 | 4619 | Inc. lycopene |
| G7 | 1210 | AP2 (58-125) | P5319 (emergent leaf primordia-expressed AS1 prom.) | P6439 | 4454 | Inc. fruit weight |
| G8 | 1256 | AP2 (151-217, 243-293) | P5297 (fruit tissue-expressed PG prom.) | P6038 | 4416 | Inc. brix |
| G8 | 1256 | AP2 (151-217, 243-293) | P5303 (fruit tissue-expressed PD prom.) | P6038 | 4416 | Inc. brix |
| G8 | 1256 | AP2 (151-217, 243-293) | P5318 (shoot apical meristem-expressed STM prom.) | P6038 | 4416 | Inc. brix |
| G15 | 230 | AP2 (281-357, 383-451) | P5284 (leaf-expressed RbcS3 prom.) | P9218 | 4812 | Inc. lycopene |
| G19 | 416 | AP2 (76-143) | P5297 (fruit tissue-expressed PG prom.) | P5056 | 4370 | Inc. brix |
| G19 | 416 | AP2 (76-143) | P5297 (fruit tissue-expressed PG prom.) | P5056 | 4370 | Inc. lycopene |
| G20 | 466 | AP2 (68-144) | P5284 (leaf-expressed RbcS3 prom.) | P9251 | 4816 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G20 | 466 | AP2 (68-144) | P5297 (fruit tissue-expressed PG prom.) | P9251 | 4816 | Inc. lycopene |
| G20 | 466 | AP2 (68-144) | P5284 (leaf-expressed RbcS3 prom.) | P9251 | 4816 | Inc. lycopene |
| G21 | 516 | AP2 (97-164) | P5324 (fruit vascular tissue-expressed Cru prom.) | P4364 | 4290 | Inc. lycopene |
| G22 | 570 | AP2 (88-152) | P5326 (floral meristem-expressed AP1 prom.) | P3376 | 4182 | Inc. brix |
| G22 | 570 | AP2 (88-152) | P5284 (leaf-expressed RbcS3 prom.) | P3376 | 4182 | Inc. lycopene |
| G22 | 570 | AP2 (88-152) | P5303 (fruit tissue-expressed PD prom.) | P3376 | 4182 | Inc. lycopene |
| G22 | 570 | AP2 (88-152) | P5326 (floral meristem-expressed AP1 prom.) | P3376 | 4182 | Inc. lycopene |
| G26 | 728 | AP2 (67-134) | P5297 (fruit tissue-expressed PG prom.) | P9131 | 4790 | Inc. lycopene |
| G28 | 828 | AP2 (145-208) | P5326 (floral meristem-expressed AP1 prom.) | P7826 | 4620 | Inc. lycopene |
| G28 | 828 | AP2 (145-208) | P5297 (fruit tissue-expressed PG prom.) | P7826 | 4620 | Inc. lycopene |
| G28 | 828 | AP2 (145-208) | P5287 (epidermal tissue-expressed LTP1 prom.) | P7826 | 4620 | Inc. lycopene |
| G29 | 884 | AP2 (134-197) | P5284 (leaf-expressed RbcS3 prom.) | P6441 | 4455 | Inc. brix |
| G30 | 946 | AP2 (16-80) | P5297 (fruit tissue-expressed PG prom.) | P3852 | 4223 | Inc. brix |
| G32 | 1002 | AP2 (17-84) | P6506 (constitutive CaMv 35S prom.) | P6849 | 4480 | Inc. brix |
| G32 | 1002 | AP2 (17-84) | P5324 (fruit vascular tissue-expressed Cru prom.) | P6849 | 4480 | Inc. fruit weight |
| G35 | 1022 | AP2 (NA) | P5326 (floral meristem-expressed AP1 prom.) | P5130 | 4383 | Inc. fruit weight |
| G35 | 1022 | AP2 (NA) | P5318 (shoot apical meristem-expressed STM prom.) | P5130 | 4383 | Inc. fruit weight |
| G36 | 1034 | AP2 (NA) | P5297 (fruit tissue-expressed PG prom.) | P6149 | 4426 | Inc. brix |
| G43 | 1072 | AP2 (104-172) | P5287 (epidermal tissue-expressed LTP1 prom.) | P9092 | 4778 | Inc. fruit weight |
| G43 | 1072 | AP2 (104-172) | P5326 (floral meristem-expressed AP1 prom.) | P9092 | 4778 | Inc. fruit weight |
| G47 | 1096 | AP2 (10-75) | P5318 (shoot apical meristem-expressed STM prom.) | P3853 | 4224 | Inc. lycopene |
| G137 | 154 | MADS (1-57) | P5297 (fruit tissue-expressed PG prom.) | P7474 | 4555 | Inc. brix |
| G137 | 154 | MADS (1-57) | P6506 (constitutive CaMv 35S prom.) | P7474 | 4555 | Inc. brix |
| G137 | 154 | MADS (1-57) | P5324 (fruit vascular tissue-expressed Cru prom.) | P7474 | 4555 | Inc. brix |
| G138 | 158 | MADS (1-57) | P5284 (leaf-expressed RbcS3 prom.) | P7475 | 4556 | Inc. brix |
| G139 | 166 | MADS (1-57) | P5319 (emergent leaf primordia-expressed AS1 prom.) | P7476 | 4557 | Inc. fruit weight |
| G140 | 172 | MADS (16-72) | P5318 (shoot apical meristem-expressed STM prom.) | P7771 | 4611 | Inc. fruit weight |
| G145 | 196 | MADS (1-57) | P5297 (fruit tissue-expressed PG prom.) | P8652 | 4730 | Inc. fruit weight |
| G146 | 202 | MADS (1-57) | P5318 (shoot apical meristem-expressed STM prom.) | P7477 | 4558 | Inc. lycopene |
| G148 | 216 | MADS (1-57) | P5326 (floral meristem-expressed AP1 prom.) | P8537 | 4695 | Inc. fruit weight |
| G154 | 254 | MADS (2-57) | P5326 (floral meristem-expressed AP1 prom.) | P9152 | 4799 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G156 | 270 | MADS (2-57) | P5326 (floral meristem-expressed AP1 prom.) | P3354 | 4176 | Inc. lycopene |
| G157 | 272 | MADS (2-57) | P6506 (constitutive CaMv 35S prom.) | P6885 | 4492 | Inc. brix |
| G159 | 274 | MADS (7-61) | P5287 (epidermal tissue-expressed LTP1 prom.) | P4955 | 4369 | Inc. lycopene |
| G165 | 292 | MADS (7-62) | P5284 (leaf-expressed RbcS3 prom.) | P7065 | 4510 | Inc. brix |
| G166 | 300 | MADS (2-56) | P5297 (fruit tissue-expressed PG prom.) | P7056 | 4507 | Inc. lycopene |
| G167 | 310 | MADS (2-57) | P5318 (shoot apical meristem-expressed STM prom.) | P6872 | 4487 | Inc. brix |
| G168 | 314 | MADS (1-57) | P5326 (floral meristem-expressed AP1 prom.) | P7059 | 4508 | Inc. fruit weight |
| G168 | 314 | MADS (1-57) | P5287 (epidermal tissue-expressed LTP1 prom.) | P7059 | 4508 | Inc. fruit weight |
| G179 | 356 | WRKY (65-121) | P6506 (constitutive CaMv 35S prom.) | P6892 | 4493 | Inc. lycopene |
| G179 | 356 | WRKY (65-121) | P5287 (epidermal tissue-expressed LTP1 prom.) | P6892 | 4493 | Inc. lycopene |
| G179 | 356 | WRKY (65-121) | P5297 (fruit tissue-expressed PG prom.) | P6892 | 4493 | Inc. lycopene |
| G189 | 410 | WRKY (240-297) | P5318 (shoot apical meristem-expressed STM prom.) | P3357 | 4177 | Inc. fruit weight |
| G190 | 418 | WRKY (110-169) | P5318 (shoot apical meristem-expressed STM prom.) | P5142 | 4384 | Inc. lycopene |
| G190 | 418 | WRKY (110-169) | P5326 (floral meristem-expressed AP1 prom.) | P5142 | 4384 | Inc. lycopene |
| G194 | 438 | WRKY (174-230) | P5318 (shoot apical meristem-expressed STM prom.) | P3582 | 4194 | Inc. lycopene |
| G194 | 438 | WRKY (174-230) | P5284 (leaf-expressed RbcS3 prom.) | P3582 | 4194 | Inc. lycopene |
| G194 | 438 | WRKY (174-230) | P5284 (leaf-expressed RbcS3 prom.) | P3582 | 4194 | Inc. brix |
| G204 | 482 | MYB-related (6-54) | P5318 (shoot apical meristem-expressed STM prom.) | P9076 | 4774 | Inc. brix |
| G204 | 482 | MYB-related (6-54) | P5287 (epidermal tissue-expressed LTP1 prom.) | P9076 | 4774 | Inc. brix |
| G206 | 490 | MYB-(R1)R2R3 (13-116) | P5287 (epidermal tissue-expressed LTP1 prom.) | P9137 | 4793 | Inc. brix |
| G206 | 490 | MYB-(R1)R2R3 (13-116) | P5326 (floral meristem-expressed AP1 prom.) | P9137 | 4793 | Inc. lycopene |
| G206 | 490 | MYB-(R1)R2R3 (13-116) | P5310 (root-expressed RSI1 prom.) | P9137 | 4793 | Inc. lycopene |
| G209 | 510 | MYB-related (36-82) | P5318 (shoot apical meristem-expressed STM prom.) | P3765 | 4213 | Inc. fruit weight |
| G210 | 518 | MYB-(R1)R2R3 (14-114) | P5297 (fruit tissue-expressed PG prom.) | P9123 | 4788 | Inc. fruit weight |
| G210 | 518 | MYB-(R1)R2R3 (14-114) | P5318 (shoot apical meristem-expressed STM prom.) | P9123 | 4788 | Inc. fruit weight |
| G210 | 518 | MYB-(R1)R2R3 (14-114) | P5287 (epidermal tissue-expressed LTP1 prom.) | P9123 | 4788 | Inc. fruit weight |
| G210 | 518 | MYB-(R1)R2R3 (14-114) | P5284 (leaf-expressed RbcS3 prom.) | P9123 | 4788 | Inc. fruit weight |
| G210 | 518 | MYB-(R1)R2R3 (14-114) | P5326 (floral meristem-expressed AP1 prom.) | P9123 | 4788 | Inc. fruit weight |
| G211 | 528 | MYB-(R1)R2R3 (24-137) | P5287 (epidermal tissue-expressed LTP1 prom.) | P4359 | 4288 | Inc. lycopene |
| G211 | 528 | MYB-(R1)R2R3 (24-137) | P5318 (shoot apical meristem-expressed STM prom.) | P4359 | 4288 | Inc. lycopene |
| G216 | 564 | MYB-(R1)R2R3 (49-151) | P5310 (root-expressed RSI1 prom.) | P9134 | 4791 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G217 | 566 | MYB-related (8-55) | P5287 (epidermal tissue-expressed LTP1 prom.) | P5842 | 4406 | Inc. lycopene |
| G219 | 568 | MYB-related (98-146) | P5303 (fruit tissue-expressed PD prom.) | P7082 | 4514 | Inc. brix |
| G219 | 568 | MYB-related (98-146) | P5318 (shoot apical meristem-expressed STM prom.) | P7082 | 4514 | Inc. brix |
| G219 | 568 | MYB-related (98-146) | P5284 (leaf-expressed RbcS3 prom.) | P7082 | 4514 | Inc. brix |
| G219 | 568 | MYB-related (98-146) | P5326 (floral meristem-expressed AP1 prom.) | P7082 | 4514 | Inc. brix |
| G222 | 576 | MYB-(R1)R2R3 (13-119) | P5310 (root-expressed RSI1 prom.) | P5839 | 4405 | Inc. lycopene |
| G225 | 588 | MYB-related (36-80) | P5310 (root-expressed RSI1 prom.) | P9125 | 4789 | Inc. brix |
| G225 | 588 | MYB-related (36-80) | P5326 (floral meristem-expressed AP1 prom.) | P9125 | 4789 | Inc. fruit weight |
| G227 | 596 | MYB-(R1)R2R3 (13-113) | P5297 (fruit tissue-expressed PG prom.) | P4021 | 4247 | Inc. brix |
| G229 | 598 | MYB-(R1)R2R3 (14-120) | P5284 (leaf-expressed RbcS3 prom.) | P7860 | 4627 | Inc. brix |
| G232 | 622 | MYB-(R1)R2R3 (14-115) | P5284 (leaf-expressed RbcS3 prom.) | P9119 | 4786 | Inc. brix |
| G236 | 632 | MYB-(R1)R2R3 (NA) | P5287 (epidermal tissue-expressed LTP1 prom.) | P5843 | 4407 | Inc. brix |
| G236 | 632 | MYB-(R1)R2R3 (NA) | P6506 (constitutive CaMv 35S prom.) | P5843 | 4407 | Inc. biomass |
| G236 | 632 | MYB-(R1)R2R3 (NA) | P5284 (leaf-expressed RbcS3 prom.) | P5843 | 4407 | Inc. biomass |
| G237 | 634 | MYB-(R1)R2R3 (11-113) | P5303 (fruit tissue-expressed PD prom.) | P4877 | 4361 | Inc. lycopene |
| G237 | 634 | MYB-(R1)R2R3 (11-113) | P5297 (fruit tissue-expressed PG prom.) | P4877 | 4361 | Inc. lycopene |
| G237 | 634 | MYB-(R1)R2R3 (11-113) | P5284 (leaf-expressed RbcS3 prom.) | P4877 | 4361 | Dark green leaves |
| G239 | 644 | MYB-(R1)R2R3 (21-125) | P5287 (epidermal tissue-expressed LTP1 prom.) | P5843 | 4407 | Inc. brix |
| G239 | 644 | MYB-(R1)R2R3 (21-125) | P5287 (epidermal tissue-expressed LTP1 prom.) | P5843 | 4407 | Inc. lycopene |
| G239 | 644 | MYB-(R1)R2R3 (21-125) | P5318 (shoot apical meristem-expressed STM prom.) | P5843 | 4407 | Inc. lycopene |
| G241 | 650 | MYB-(R1)R2R3 (14-114) | P5297 (fruit tissue-expressed PG prom.) | P9136 | 4792 | Inc. lycopene |
| G242 | 654 | MYB-(R1)R2R3 (6-106) | P5310 (root-expressed RSI1 prom.) | P9121 | 4787 | Inc. lycopene |
| G242 | 654 | MYB-(R1)R2R3 (6-106) | P5326 (floral meristem-expressed AP1 prom.) | P9121 | 4787 | Inc. fruit weight |
| G242 | 654 | MYB-(R1)R2R3 (6-106) | P5297 (fruit tissue-expressed PG prom.) | P9121 | 4787 | Inc. fruit weight |
| G242 | 654 | MYB-(R1)R2R3 (6-106) | P5284 (leaf-expressed RbcS3 prom.) | P9121 | 4787 | Inc. fruit weight |
| G242 | 654 | MYB-(R1)R2R3 (6-106) | P5287 (epidermal tissue-expressed LTP1 prom.) | P9121 | 4787 | Inc. fruit weight |
| G243 | 666 | MYB-(R1)R2R3 (12-128) | P5326 (floral meristem-expressed AP1 prom.) | P7459 | 4551 | Inc. brix |
| G245 | 670 | MYB-(R1)R2R3 (14-114) | P5284 (leaf-expressed RbcS3 prom.) | P7007 | 4500 | Inc. fruit weight |
| G246 | 678 | MYB-(R1)R2R3 (57-159) | P5297 (fruit tissue-expressed PG prom.) | P9046 | 4770 | Inc. lycopene |
| G255 | 696 | MYB-(R1)R2R3 (14-116) | P5318 (shoot apical meristem-expressed STM prom.) | P6841 | 4479 | Inc. fruit weight |
| G258 | 720 | MYB-(R1)R2R3 (24-124) | P5297 (fruit tissue-expressed PG prom.) | P4194 | 4267 | Inc. brix |
| G258 | 720 | MYB-(R1)R2R3 (24-124) | P5326 (floral meristem-expressed AP1 prom.) | P4194 | 4267 | Inc. fruit weight |
| G259 | 726 | HS (40-131) | P5287 (epidermal tissue-expressed LTP1 prom.) | P4172 | 4261 | Inc. lycopene |
| G261 | 734 | HS (15-106) | P5297 (fruit tissue-expressed PG prom.) | P5145 | 4385 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G262 | 738 | HS (52-143) | P5284 (leaf-expressed RbcS3 prom.) | P4759 | 4347 | Inc. lycopene |
| G264 | 746 | HS (23-114) | P5284 (leaf-expressed RbcS3 prom.) | P8948 | 4764 | Inc. fruit weight |
| G264 | 746 | HS (23-114) | P5318 (shoot apical meristem-expressed STM prom.) | P8948 | 4764 | Inc. fruit weight |
| G264 | 746 | HS (23-114) | P5287 (epidermal tissue-expressed LTP1 prom.) | P8948 | 4764 | Inc. fruit weight |
| G265 | 750 | HS (13-104) | P5297 (fruit tissue-expressed PG prom.) | P7086 | 4517 | Inc. brix |
| G268 | 762 | AKR (186-689) | P5287 (epidermal tissue-expressed LTP1 prom.) | P8695 | 4748 | Inc. fruit weight |
| G273 | 794 | AKR (93-610) | P5318 (shoot apical meristem-expressed STM prom.) | P6817 | 4474 | Inc. fruit weight |
| G274 | 798 | AKR (94-600) | P5287 (epidermal tissue-expressed LTP1 prom.) | P7087 | 4518 | Inc. fruit weight |
| G277 | 812 | AKR (28-173) | P5319 (emergent leaf primordia-expressed AS1 prom.) | P7162 | 4541 | Inc. fruit weight |
| G279 | 820 | HMG (31-103) | P5303 (fruit tissue-expressed PD prom.) | P7021 | 4502 | Inc. brix |
| G280 | 830 | AT-hook (97-104, 130-137-155-162, 185-192) | P5324 (fruit vascular tissue-expressed Cru prom.) | P6901 | 4497 | Inc. brix |
| G285 | 860 | MISC (NA) | P5297 (fruit tissue-expressed PG prom.) | P5248 | 4386 | Inc. brix |
| G286 | 866 | ENBP (206-252, 332-409, 588-786) | P5284 (leaf-expressed RbcS3 prom.) | P5249 | 4387 | Inc. brix |
| G286 | 866 | ENBP (206-252, 332-409, 588-786) | P5297 (fruit tissue-expressed PG prom.) | P5249 | 4387 | Inc. brix |
| G286 | 866 | ENBP (206-252, 332-409, 588-786) | P6506 (constitutive CaMv 35S prom.) | P5249 | 4387 | Inc. brix |
| G286 | 866 | ENBP (206-252, 332-409, 588-786) | P5319 (emergent leaf primordia-expressed AS1 prom.) | P5249 | 4387 | Inc. brix |
| G286 | 866 | ENBP (206-252, 332-409, 588-786) | P5326 (floral meristem-expressed AP1 prom.) | P5249 | 4387 | Inc. brix |
| G288 | 870 | MISC (309-361) | P5287 (epidermal tissue-expressed LTP1 prom.) | P6452 | 4458 | Inc. fruit weight |
| G288 | 870 | MISC (309-361) | P5284 (leaf-expressed RbcS3 prom.) | P6452 | 4458 | Inc. fruit weight |
| G290 | 886 | SWI/SNF (538-784, 919-958, 1086-1169) | P5284 (leaf-expressed RbcS3 prom.) | P4785 | 4360 | Inc. fruit weight |
| G290 | 886 | SWI/SNF (538-784, 919-958, 1086-1169) | P5287 (epidermal tissue-expressed LTP1 prom.) | P4785 | 4360 | Inc. fruit weight |
| G294 | 908 | MISC (NA) | P5297 (fruit tissue-expressed PG prom.) | P4560 | 4313 | Inc. brix |
| G295 | 910 | bZIP (287-354) | P5318 (shoot apical meristem-expressed STM prom.) | P4783 | 4359 | Inc. brix |
| G306 | 974 | SCR (370-435, 486-573, 576-649) | P5324 (fruit vascular tissue-expressed Cru prom.) | | | Inc. lycopene |
| G309 | 992 | SCR (223-288, 342-427, 431-505) | P5287 (epidermal tissue-expressed LTP1 prom.) | P9195 | 4811 | Inc. fruit weight |
| G321 | 1004 | RING/C3HC4 (NA) | P5297 (fruit tissue-expressed PG prom.) | | | Inc. fruit weight |
| G322 | 1006 | RING/C3HC4 (NA) | P5287 (epidermal tissue-expressed LTP1 prom.) | | | Inc. lycopene |
| G323 | 1008 | RING/C3HC4 (48-96) | P5297 (fruit tissue-expressed PG prom.) | P4201 | 4269 | Inc. brix |
| G323 | 1008 | RING/C3HC4 (48-96) | P5318 (shoot apical meristem-expressed STM prom.) | P4201 | 4269 | Inc. lycopene |
| G326 | 1010 | Z-CO-like (11-94, 354-400) | P5303 (fruit tissue-expressed PD prom.) | P5256 | 4388 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G326 | 1010 | Z-CO-like (11-94, 354-400) | P6506 (constitutive CaMv 35S prom.) | P5256 | 4388 | Inc. brix |
| G326 | 1010 | Z-CO-like (11-94, 354-400) | P5284 (leaf-expressed RbcS3 prom.) | P5256 | 4388 | Inc. brix |
| G328 | 1012 | Z-CO-like (12-78) | P5297 (fruit tissue-expressed PG prom.) | P3955 | 4227 | Inc. lycopene |
| G328 | 1012 | Z-CO-like (12-78) | P5326 (floral meristem-expressed AP1 prom.) | P3955 | 4227 | Inc. lycopene |
| G335 | 1014 | Z-Tall-1 (205-218) | P5287 (epidermal tissue-expressed LTP1 prom.) | P8167 | 4653 | Inc. brix |
| G335 | 1014 | Z-Tall-1 (205-218) | P5287 (epidermal tissue-expressed LTP1 prom.) | P8167 | 4653 | Inc. lycopene |
| G341 | 1016 | Z-C3H (254-374) | P5297 (fruit tissue-expressed PG prom.) | P8566 | 4703 | Inc. brix |
| G344 | 1018 | GATA/Zn (166-192) | P5287 (epidermal tissue-expressed LTP1 prom.) | P6181 | 4431 | Inc. brix |
| G344 | 1018 | GATA/Zn (166-192) | P5326 (floral meristem-expressed AP1 prom.) | P6181 | 4431 | Inc. brix |
| G345 | 1020 | GATA/Zn (NA) | P5287 (epidermal tissue-expressed LTP1 prom.) | P6819 | 4475 | Inc. brix |
| G350 | 1024 | Z-C2H2 (91-113, 150-170) | P5326 (floral meristem-expressed AP1 prom.) | P6197 | 4434 | Inc. brix |
| G351 | 1026 | Z-C2H2 (77-97, 118-140) | P5284 (leaf-expressed RbcS3 prom.) | P7773 | 4612 | Inc. lycopene |
| G351 | 1026 | Z-C2H2 (77-97, 118-140) | P5297 (fruit tissue-expressed PG prom.) | P7773 | 4612 | Inc. lycopene |
| G352 | 1028 | Z-C2H2 (99-119, 166-186) | P5284 (leaf-expressed RbcS3 prom.) | P4225 | 4276 | Inc. brix |
| G354 | 1030 | Z-C2H2 (42-62, 88-109) | P5297 (fruit tissue-expressed PG prom.) | P4535 | 4310 | Inc. brix |
| G354 | 1030 | Z-C2H2 (42-62, 88-109) | P5284 (leaf-expressed RbcS3 prom.) | P4535 | 4310 | Inc. brix |
| G354 | 1030 | Z-C2H2 (42-62, 88-109) | P5287 (epidermal tissue-expressed LTP1 prom.) | P4535 | 4310 | Inc. fruit weight |
| G357 | 1032 | Z-C2H2 (7-29) | P5326 (floral meristem-expressed AP1 prom.) | | | Inc. lycopene |
| G362 | 1036 | Z-C2H2 (62-82) | P5324 (fruit vascular tissue-expressed Cru prom.) | P6468 | 4464 | Inc. fruit weight |
| G363 | 1038 | Z-C2H2 (87-108) | P5287 (epidermal tissue-expressed LTP1 prom.) | | | Inc. lycopene |
| G365 | 1040 | Z-C2H2 (70-90) | P5303 (fruit tissue-expressed PD prom.) | P6820 | 4476 | Inc. brix |
| G368 | 1042 | Z-C2H2 (NA) | P5324 (fruit vascular tissue-expressed Cru prom.) | P5262 | 4389 | Inc. lycopene |
| G379 | 1044 | RING/C3HC4 (16-56) | P5318 (shoot apical meristem-expressed STM prom.) | P8225 | 4665 | Inc. fruit weight |
| G383 | 1046 | GATA/Zn (77-102) | P5318 (shoot apical meristem-expressed STM prom.) | P4352 | 4285 | Inc. lycopene |
| G383 | 1046 | GATA/Zn (77-102) | P5303 (fruit tissue-expressed PD prom.) | P4352 | 4285 | Inc. fruit weight |
| G385 | 1048 | HB (60-123) | P5287 (epidermal tissue-expressed LTP1 prom.) | P8937 | 4762 | Inc. fruit weight |
| G385 | 1048 | HB (60-123) | P5284 (leaf-expressed RbcS3 prom.) | P8937 | 4762 | Inc. fruit weight |
| G385 | 1048 | HB (60-123) | P5318 (shoot apical meristem-expressed STM prom.) | P8937 | 4762 | Inc. fruit weight |
| G392 | 1050 | HB (15-75) | P5318 (shoot apical meristem-expressed STM prom.) | P9145 | 4796 | Inc. fruit weight |
| G399 | 1052 | HB (126-186) | P5287 (epidermal tissue-expressed LTP1 prom.) | P5060 | 4371 | Inc. lycopene |
| G399 | 1052 | HB (126-186) | P5326 (floral meristem-expressed AP1 prom.) | P5060 | 4371 | Inc. lycopene |
| G406 | 1056 | HB (58-118) | P5326 (floral meristem-expressed AP1 prom.) | P4533 | 4309 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G409 | 1058 | HB (64-124) | P5318 (shoot apical meristem-expressed STM prom.) | P9141 | 4794 | Inc. fruit weight |
| G411 | 1060 | HB (NA) | P5319 (emergent leaf primordia-expressed AS1 prom.) | P9142 | 4795 | Inc. brix |
| G411 | 1060 | HB (NA) | P5310 (root-expressed RSI1 prom.) | P9142 | 4795 | Inc. brix |
| G411 | 1060 | HB (NA) | P5310 (root-expressed RSI1 prom.) | P9142 | 4795 | Inc. lycopene |
| G413 | 1062 | HB (37-97) | P5318 (shoot apical meristem-expressed STM prom.) | P8730 | 4754 | Inc. fruit weight |
| G413 | 1062 | HB (37-97) | P5326 (floral meristem-expressed AP1 prom.) | P8730 | 4754 | Inc. fruit weight |
| G413 | 1062 | HB (37-97) | P5297 (fruit tissue-expressed PG prom.) | P8730 | 4754 | Inc. fruit weight |
| G415 | 1064 | HB (550-610) | P5297 (fruit tissue-expressed PG prom.) | P6044 | 4418 | Inc. brix |
| G415 | 1064 | HB (550-610) | P5284 (leaf-expressed RbcS3 prom.) | P6044 | 4418 | Inc. brix |
| G421 | 1066 | HB (371-434) | P5297 (fruit tissue-expressed PG prom.) | P8206 | 4658 | Inc. lycopene |
| G426 | 1068 | HB (346-406) | P5326 (floral meristem-expressed AP1 prom.) | P6445 | 4456 | Inc. fruit weight |
| G428 | 1070 | HB (229-292) | P5297 (fruit tissue-expressed PG prom.) | P5061 | 4372 | Inc. brix |
| G432 | 1074 | HB (NA) | P5287 (epidermal tissue-expressed LTP1 prom.) | P3967 | 4230 | Inc. lycopene |
| G432 | 1074 | HB (NA) | P5318 (shoot apical meristem-expressed STM prom.) | P3967 | 4230 | Inc. fruit weight |
| G435 | 1076 | HB (4-67) | P5284 (leaf-expressed RbcS3 prom.) | P3771 | 4214 | Inc. lycopene |
| G440 | 1078 | AP2 (122-184) | P5303 (fruit tissue-expressed PD prom.) | P5265 | 4390 | Inc. brix |
| G443 | 1080 | IAA (NA) | P5297 (fruit tissue-expressed PG prom.) | P9079 | 4775 | Inc. brix |
| G443 | 1080 | IAA (NA) | P5297 (fruit tissue-expressed PG prom.) | P9079 | 4775 | Inc. lycopene |
| G443 | 1080 | IAA (NA) | P5310 (root-expressed RSI1 prom.) | P9079 | 4775 | Inc. lycopene |
| G449 | 1082 | IAA (NA) | P5326 (floral meristem-expressed AP1 prom.) | P5266 | 4391 | Inc. brix |
| G450 | 1084 | IAA (6-14, 78-89, 112-128, 180-217) | P5318 (shoot apical meristem-expressed STM prom.) | P4012 | 4244 | Inc. lycopene |
| G450 | 1084 | IAA (6-14, 78-89, 112-128, 180-217) | P5326 (floral meristem-expressed AP1 prom.) | P4012 | 4244 | Inc. lycopene |
| G451 | 1086 | IAA (12-20, 57-68, 76-92, 131-164) | P5297 (fruit tissue-expressed PG prom.) | P9081 | 4776 | Inc. brix |
| G452 | 1088 | IAA (NA) | P5287 (epidermal tissue-expressed LTP1 prom.) | P5065 | 4373 | Inc. brix |
| G463 | 1090 | IAA (14-23, 77-88, 130-146, 194-227) | P5318 (shoot apical meristem-expressed STM prom.) | P5067 | 4374 | Inc. lycopene |
| G463 | 1090 | IAA (14-23, 77-88, 130-146, 194-227) | P5284 (leaf-expressed RbcS3 prom.) | P5067 | 4374 | Inc. lycopene |
| G467 | 1092 | IAA (NA) | P5287 (epidermal tissue-expressed LTP1 prom.) | P7027 | 4503 | Inc. fruit weight |
| G468 | 1094 | IAA (86-102, 141-171) | P5297 (fruit tissue-expressed PG prom.) | P7537 | 4576 | Inc. brix |
| G468 | 1094 | IAA (86-102, 141-171) | P5297 (fruit tissue-expressed PG prom.) | P7537 | 4576 | Inc. lycopene |
| G481 | 1098 | CAAT (20-109) | P5324 (fruit vascular tissue-expressed Cru prom.) | P6812 | 4473 | Inc. fruit weight |
| G481 | 1098 | CAAT (20-109) | P5326 (floral meristem-expressed AP1 prom.) | P6812 | 4473 | Inc. fruit weight |
| G482 | 1100 | CAAT (26-115) | P5287 (epidermal tissue-expressed LTP1 prom.) | P5072 | 4375 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G485 | 1102 | CAAT (20-109) | P5318 (shoot apical meristem-expressed STM prom.) | P4190 | 4266 | Inc. fruit weight |
| G489 | 1104 | CAAT (68-164) | P5297 (fruit tissue-expressed PG prom.) | P3404 | 4183 | Inc. brix |
| G501 | 1106 | NAC (10-131) | P5318 (shoot apical meristem-expressed STM prom.) | P5272 | 4392 | Inc. brix |
| G501 | 1106 | NAC (10-131) | P5303 (fruit tissue-expressed PD prom.) | P5272 | 4392 | Inc. brix |
| G508 | 1108 | NAC (NA) | P5319 (emergent leaf primordia-expressed AS1 prom.) | P5274 | 4393 | Inc. brix |
| G508 | 1108 | NAC (NA) | P5303 (fruit tissue-expressed PD prom.) | P5274 | 4393 | Inc. brix |
| G513 | 1110 | NAC (16-161) | P5287 (epidermal tissue-expressed LTP1 prom.) | P5507 | 4394 | Inc. fruit weight |
| G519 | 1112 | NAC (10-131) | P5297 (fruit tissue-expressed PG prom.) | P9098 | 4779 | Inc. brix |
| G522 | 1114 | NAC (10-165) | P6506 (constitutive CaMv 35S prom.) | P4942 | 4366 | Inc. brix |
| G525 | 1116 | NAC (23-167) | P5287 (epidermal tissue-expressed LTP1 prom.) | P5076 | 4376 | Inc. fruit weight |
| G525 | 1116 | NAC (23-167) | P5318 (shoot apical meristem-expressed STM prom.) | P5076 | 4376 | Inc. fruit weight |
| G525 | 1116 | NAC (23-167) | P5326 (floral meristem-expressed AP1 prom.) | P5076 | 4376 | Inc. fruit weight |
| G527 | 1118 | NAC (NA) | P5326 (floral meristem-expressed AP1 prom.) | P6470 | 4465 | Inc. brix |
| G527 | 1118 | NAC (NA) | P5297 (fruit tissue-expressed PG prom.) | P6470 | 4465 | Inc. brix |
| G527 | 1118 | NAC (NA) | P5303 (fruit tissue-expressed PD prom.) | P6470 | 4465 | Inc. brix |
| G527 | 1118 | NAC (NA) | P6506 (constitutive CaMv 35S prom.) | P6470 | 4465 | Inc. brix |
| G529 | 1120 | GF14 (229-236) | P5303 (fruit tissue-expressed PD prom.) | P5513 | 4395 | Inc. brix |
| G530 | 1122 | GF14 (227-235) | P5284 (leaf-expressed RbcS3 prom.) | P4523 | 4307 | Inc. brix |
| G530 | 1122 | GF14 (227-235) | P5287 (epidermal tissue-expressed LTP1 prom.) | P4523 | 4307 | Inc. fruit weight |
| G531 | 1124 | GF14 (227-234) | P5326 (floral meristem-expressed AP1 prom.) | P7130 | 4530 | Inc. brix |
| G531 | 1124 | GF14 (227-234) | P5287 (epidermal tissue-expressed LTP1 prom.) | P7130 | 4530 | Inc. brix |
| G532 | 1126 | GF14 (NA) | P5297 (fruit tissue-expressed PG prom.) | P7131 | 4531 | Inc. brix |
| G547 | 1128 | Z-C2H2 (79-99, 164-184, 222-244) | P5326 (floral meristem-expressed AP1 prom.) | P8614 | 4716 | Inc. fruit weight |
| G553 | 1130 | bZIP (94-160) | P6506 (constitutive CaMv 35S prom.) | P3778 | 4215 | Inc. lycopene |
| G553 | 1130 | bZIP (94-160) | P5303 (fruit tissue-expressed PD prom.) | P3778 | 4215 | Inc. fruit weight |
| G556 | 1132 | bZIP (83-143) | P5287 (epidermal tissue-expressed LTP1 prom.) | P4162 | 4259 | Inc. fruit weight |
| G558 | 1134 | bZIP (45-105) | P5319 (emergent leaf primordia-expressed AS1 prom.) | P3573 | 4191 | Inc. lycopene |
| G558 | 1134 | bZIP (45-105) | P5318 (shoot apical meristem-expressed STM prom.) | P3573 | 4191 | Inc. lycopene |
| G559 | 1136 | bZIP (203-264) | P5326 (floral meristem-expressed AP1 prom.) | P3585 | 4195 | Inc. lycopene |
| G562 | 1138 | bZIP (253-315) | P5318 (shoot apical meristem-expressed STM prom.) | P6000 | 4412 | Inc. fruit weight |
| G563 | 1140 | bZIP (186-248) | P5318 (shoot apical meristem-expressed STM prom.) | P4896 | 4363 | Large leaflets |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G563 | 1140 | bZIP (186-248) | P5324 (fruit vascular tissue-expressed Cru prom.) | P4896 | 4363 | Large leaflets |
| G567 | 1142 | bZIP (210-270) | P5297 (fruit tissue-expressed PG prom.) | P4762 | 4348 | Inc. brix |
| G567 | 1142 | bZIP (210-270) | P5297 (fruit tissue-expressed PG prom.) | P4762 | 4348 | Inc. lycopene |
| G567 | 1142 | bZIP (210-270) | P5319 (emergent leaf primordia-expressed AS1 prom.) | P4762 | 4348 | Inc. lycopene |
| G568 | 1144 | bZIP (215-265) | P5297 (fruit tissue-expressed PG prom.) | P7120 | 4527 | Inc. brix |
| G577 | 1146 | BZIPT2 (1-53, 356-466) | P5326 (floral meristem-expressed AP1 prom.) | P4026 | 4250 | Inc. brix |
| G577 | 1146 | BZIPT2 (1-53, 356-466) | P5326 (floral meristem-expressed AP1 prom.) | P4026 | 4250 | Inc. lycopene |
| G579 | 1148 | bZIP (167-227) | P5287 (epidermal tissue-expressed LTP1 prom.) | P3981 | 4237 | Inc. lycopene |
| G579 | 1148 | bZIP (167-227) | P5287 (epidermal tissue-expressed LTP1 prom.) | P4025 | 4249 | Inc. lycopene |
| G580 | 1150 | bZIP (162-218) | P5318 (shoot apical meristem-expressed STM prom.) | P3657 | 4212 | Inc. brix |
| G580 | 1150 | bZIP (162-218) | P5318 (shoot apical meristem-expressed STM prom.) | P3657 | 4212 | Inc. lycopene |
| G580 | 1150 | bZIP (162-218) | P6506 (constitutive CaMv 35S prom.) | P3657 | 4212 | Inc. lycopene |
| G580 | 1150 | bZIP (162-218) | P5287 (epidermal tissue-expressed LTP1 prom.) | P6493 | 4469 | Inc. fruit weight |
| G588 | 1152 | HLH/MYC (313-370) | P5284 (leaf-expressed RbcS3 prom.) | P7856 | 4625 | Inc. fruit weight |
| G591 | 1154 | HLH/MYC (149-206) | P5318 (shoot apical meristem-expressed STM prom.) | P5085 | 4377 | Inc. fruit weight |
| G595 | 1156 | HLH/MYC (NA) | P5287 (epidermal tissue-expressed LTP1 prom.) | P9103 | 4780 | Inc. brix |
| G596 | 1158 | AT-hook (89-97, 98-244) | P5318 (shoot apical meristem-expressed STM prom.) | P7033 | 4504 | Inc. fruit weight |
| G598 | 1160 | DBP (205-263) | P5319 (emergent leaf primordia-expressed AS1 prom.) | P6001 | 4413 | Inc. brix |
| G598 | 1160 | DBP (205-263) | P5326 (floral meristem-expressed AP1 prom.) | P6001 | 4413 | Inc. lycopene |
| G599 | 1162 | DBP (187-219, 264-300) | P5303 (fruit tissue-expressed PD prom.) | P6417 | 4445 | Inc. brix |
| G599 | 1162 | DBP (187-219, 264-300) | P5326 (floral meristem-expressed AP1 prom.) | P6417 | 4445 | Inc. brix |
| G599 | 1162 | DBP (187-219, 264-300) | P5324 (fruit vascular tissue-expressed Cru prom.) | P6417 | 4445 | Inc. brix |
| G615 | 1164 | TEO (88-147) | P5284 (leaf-expressed RbcS3 prom.) | P7159 | 4540 | Inc. brix |
| G619 | 1166 | ARF (64-406) | P6506 (constitutive CaMv 35S prom.) | P5706 | 4403 | Inc. brix |
| G619 | 1166 | ARF (64-406) | P5326 (floral meristem-expressed AP1 prom.) | P5706 | 4403 | Inc. brix |
| G625 | 1168 | AP2 (52-119) | P5297 (fruit tissue-expressed PG prom.) | P6837 | 4478 | Inc. brix |
| G631 | 1170 | bZIP (212-282) | P5326 (floral meristem-expressed AP1 prom.) | P6460 | 4461 | Inc. lycopene |
| G634 | 1172 | TH (62-147, 189-245) | P5297 (fruit tissue-expressed PG prom.) | P7198 | 4545 | Inc. lycopene |
| G635 | 1174 | TH (239-323) | P5303 (fruit tissue-expressed PD prom.) | P3619 | 4203 | Inc. brix |
| G635 | 1174 | TH (239-323) | P5303 (fruit tissue-expressed PD prom.) | P3619 | 4203 | Inc. lycopene |
| G639 | 1176 | TH (304-389) | P5284 (leaf-expressed RbcS3 prom.) | P3641 | 4206 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G641 | 1178 | TH (23-102) | P5326 (floral meristem-expressed AP1 prom.) | P7134 | 4532 | Inc. fruit weight |
| G645 | 1180 | SCR (276-341, 392-479, 480-553) | P5297 (fruit tissue-expressed PG prom.) | P6053 | 4420 | Inc. brix |
| G645 | 1180 | SCR (276-341, 392-479, 480-553) | P5284 (leaf-expressed RbcS3 prom.) | P6053 | 4420 | Inc. lycopene |
| G649 | 1182 | RING/C3H2C3 (NA) | P5326 (floral meristem-expressed AP1 prom.) | P5091 | 4378 | Inc. brix |
| G653 | 1184 | Z-LIM (10-61, 109-160) | P5284 (leaf-expressed RbcS3 prom.) | P9248 | 4815 | Inc. lycopene |
| G655 | 1186 | MYB-(R1)R2R3 (44-206) | P5284 (leaf-expressed RbcS3 prom.) | P6430 | 4448 | Inc. lycopene |
| G655 | 1186 | MYB-(R1)R2R3 (44-206) | P5324 (fruit vascular tissue-expressed Cru prom.) | P6430 | 4448 | Inc. fruit weight |
| G658 | 1188 | MYB-(R1)R2R3 (2-105) | P5324 (fruit vascular tissue-expressed Cru prom.) | P6002 | 4414 | Inc. brix |
| G658 | 1188 | MYB-(R1)R2R3 (2-105) | P5284 (leaf-expressed RbcS3 prom.) | P6002 | 4414 | Inc. lycopene |
| G659 | 1190 | MYB-(R1)R2R3 (16-116) | P5326 (floral meristem-expressed AP1 prom.) | P6429 | 4447 | Inc. fruit weight |
| G663 | 1192 | MYB-(R1)R2R3 (9-111) | P6506 (constitutive CaMv 35S prom.) | P5094 | 4379 | Inc. fruit weight |
| G663 | 1192 | MYB-(R1)R2R3 (9-111) | P5303 (fruit tissue-expressed PD prom.) | P5094 | 4379 | Inc. fruit weight |
| G664 | 1194 | MYB-(R1)R2R3 (14-116) | P5287 (epidermal tissue-expressed LTP1 prom.) | P7015 | 4501 | Inc. lycopene |
| G665 | 1196 | MYB-related (91-139) | P5284 (leaf-expressed RbcS3 prom.) | P6430 | 4448 | Inc. lycopene |
| G666 | 1198 | MYB-(R1)R2R3 (14-116) | P5297 (fruit tissue-expressed PG prom.) | P6431 | 4449 | Inc. biomass |
| G674 | 1200 | MYB-(R1)R2R3 (20-120) | P5284 (leaf-expressed RbcS3 prom.) | P7123 | 4528 | Inc. lycopene |
| G675 | 1202 | MYB-(R1)R2R3 (13-116) | P5284 (leaf-expressed RbcS3 prom.) | P4019 | 4245 | Inc. lycopene |
| G675 | 1202 | MYB-(R1)R2R3 (13-116) | P5318 (shoot apical meristem-expressed STM prom.) | P4019 | 4245 | Inc. lycopene |
| G675 | 1202 | MYB-(R1)R2R3 (13-116) | P5319 (emergent leaf primordia-expressed AS1 prom.) | P4019 | 4245 | Inc. lycopene |
| G675 | 1202 | MYB-(R1)R2R3 (13-116) | P5326 (floral meristem-expressed AP1 prom.) | P4019 | 4245 | Inc. lycopene |
| G679 | 1204 | MYB-related (102-150) | P6506 (constitutive CaMv 35S prom.) | P6433 | 4450 | Inc. brix |
| G682 | 1206 | MYB-related (33-77) | P5287 (epidermal tissue-expressed LTP1 prom.) | P5099 | 4380 | Inc. lycopene |
| G699 | 1208 | HB (52-115) | P5287 (epidermal tissue-expressed LTP1 prom.) | P6494 | 4470 | Inc. fruit weight |
| G699 | 1208 | HB (52-115) | P5284 (leaf-expressed RbcS3 prom.) | P6494 | 4470 | Inc. fruit weight |
| G707 | 1212 | HB (109-169) | P5284 (leaf-expressed RbcS3 prom.) | P8734 | 4757 | Inc. brix |
| G707 | 1212 | HB (109-169) | P5287 (epidermal tissue-expressed LTP1 prom.) | P8734 | 4757 | Inc. brix |
| G714 | 1214 | CAAT (58-150) | P5284 (leaf-expressed RbcS3 prom.) | P7861 | 4628 | Inc. lycopene |
| G714 | 1214 | CAAT (58-150) | P5297 (fruit tissue-expressed PG prom.) | P7861 | 4628 | Inc. lycopene |
| G715 | 1216 | CAAT (53-149) | P5287 (epidermal tissue-expressed LTP1 prom.) | P8668 | 4736 | Inc. fruit weight |
| G720 | 1218 | GARP (301-349) | P5284 (leaf-expressed RbcS3 prom.) | P6076 | 4425 | Inc. lycopene |
| G720 | 1218 | GARP (301-349) | P5287 (epidermal tissue-expressed LTP1 prom.) | P6076 | 4425 | Inc. lycopene |
| G721 | 1220 | GARP (NA) | P5326 (floral meristem-expressed AP1 prom.) | P4888 | 4362 | Inc. brix |
| G722 | 1222 | GARP (188-236) | P5324 (fruit vascular tissue-expressed Cru prom.) | P6042 | 4417 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G724 | 1224 | GARP (86-134) | P5326 (floral meristem-expressed AP1 prom.) | P8493 | 4688 | Inc. brix |
| G724 | 1224 | GARP (86-134) | P5310 (root-expressed RSI1 prom.) | P8493 | 4688 | Inc. lycopene |
| G724 | 1224 | GARP (86-134) | P5287 (epidermal tissue-expressed LTP1 prom.) | P8493 | 4688 | Inc. lycopene |
| G724 | 1224 | GARP (86-134) | P5284 (leaf-expressed RbcS3 prom.) | P8493 | 4688 | Inc. fruit weight |
| G727 | 1226 | GARP (226-269) | P5287 (epidermal tissue-expressed LTP1 prom.) | P6406 | 4441 | Inc. fruit weight |
| G730 | 1228 | GARP (169-217) | P5287 (epidermal tissue-expressed LTP1 prom.) | P8528 | 4693 | Inc. lycopene |
| G732 | 1230 | bZIP (31-91) | P5318 (shoot apical meristem-expressed STM prom.) | P7084 | 4515 | Inc. fruit weight |
| G748 | 1232 | Z-Dof (112-140) | P5324 (fruit vascular tissue-expressed Cru prom.) | P3363 | 4178 | Inc. lycopene |
| G748 | 1232 | Z-Dof (112-140) | P6506 (constitutive CaMv 35S prom.) | P3363 | 4178 | Inc. lycopene |
| G748 | 1232 | Z-Dof (112-140) | P5318 (shoot apical meristem-expressed STM prom.) | P3363 | 4178 | Inc. fruit weight |
| G749 | 1234 | Z-C3H (125-177) | P5287 (epidermal tissue-expressed LTP1 prom.) | P5105 | 4381 | Inc. fruit weight |
| G751 | 1236 | Z-Dof (37-82) | P5284 (leaf-expressed RbcS3 prom.) | P6495 | 4471 | Inc. brix |
| G751 | 1236 | Z-Dof (37-82) | P5287 (epidermal tissue-expressed LTP1 prom.) | P6495 | 4471 | Inc. brix |
| G756 | 1238 | Z-C3H (199-319) | P5287 (epidermal tissue-expressed LTP1 prom.) | P7748 | 4603 | Inc. brix |
| G763 | 1240 | NAC (17-157) | P5318 (shoot apical meristem-expressed STM prom.) | P5541 | 4396 | Inc. brix |
| G763 | 1240 | NAC (17-157) | P5297 (fruit tissue-expressed PG prom.) | P5541 | 4396 | Inc. brix |
| G764 | 1242 | NAC (27-171) | P5297 (fruit tissue-expressed PG prom.) | P6496 | 4472 | Inc. brix |
| G764 | 1242 | NAC (27-171) | P5297 (fruit tissue-expressed PG prom.) | P6496 | 4472 | Inc. lycopene |
| G783 | 1244 | HLH/MYC (24-82) | P5319 (emergent leaf primordia-expressed AS1 prom.) | | | Inc. lycopene |
| G783 | 1244 | HLH/MYC (24-82) | P5318 (shoot apical meristem-expressed STM prom.) | | | Inc. fruit weight |
| G783 | 1244 | HLH/MYC (24-82) | P5287 (epidermal tissue-expressed LTP1 prom.) | | | Inc. fruit weight |
| G783 | 1244 | HLH/MYC (24-82) | P5297 (fruit tissue-expressed PG prom.) | | | Inc. fruit weight |
| G787 | 1246 | HLH/MYC (49-105) | P5297 (fruit tissue-expressed PG prom.) | P9254 | 4817 | Inc. brix |
| G787 | 1246 | HLH/MYC (49-105) | P5287 (epidermal tissue-expressed LTP1 prom.) | P9254 | 4817 | Inc. brix |
| G787 | 1246 | HLH/MYC (49-105) | P5326 (floral meristem-expressed AP1 prom.) | P9254 | 4817 | Inc. brix |
| G789 | 1248 | HLH/MYC (253-310) | P5324 (fruit vascular tissue-expressed Cru prom.) | P7068 | 4511 | Inc. brix |
| G790 | 1250 | HLH/MYC (NA) | P5284 (leaf-expressed RbcS3 prom.) | P4044 | 4254 | Inc. brix |
| G792 | 1252 | HLH/MYC (63-122) | P5318 (shoot apical meristem-expressed STM prom.) | P7110 | 4524 | Inc. brix |
| G792 | 1252 | HLH/MYC (63-122) | P5319 (emergent leaf primordia-expressed AS1 prom.) | P7110 | 4524 | Inc. brix |
| G793 | 1254 | HLH/MYC (147-204) | P5287 (epidermal tissue-expressed LTP1 prom.) | P5111 | 4382 | Inc. brix |
| G793 | 1254 | HLH/MYC (147-204) | P5287 (epidermal tissue-expressed LTP1 prom.) | P5111 | 4382 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G810 | 1258 | HS (23-114) | P5284 (leaf-expressed RbcS3 prom.) | P4763 | 4349 | Inc. brix |
| G811 | 1260 | HS (17-108) | P5326 (floral meristem-expressed AP1 prom.) | P8573 | 4704 | Inc. fruit weight |
| G811 | 1260 | HS (17-108) | P5287 (epidermal tissue-expressed LTP1 prom.) | P8573 | 4704 | Inc. fruit weight |
| G811 | 1260 | HS (17-108) | P5318 (shoot apical meristem-expressed STM prom.) | P8573 | 4704 | Inc. fruit weight |
| G812 | 1262 | HS (29-120) | P5284 (leaf-expressed RbcS3 prom.) | P3650 | 4209 | Inc. lycopene |
| G819 | 1264 | AKR (88-598) | P5284 (leaf-expressed RbcS3 prom.) | P8953 | 4765 | Inc. brix |
| G830 | 1266 | AKR (89-601) | P5324 (fruit vascular tissue-expressed Cru prom.) | P6165 | 4428 | Inc. brix |
| G843 | 1268 | MISC (60-119, 270-350) | P6506 (constitutive CaMv 35S prom.) | P4559 | 4312 | Inc. lycopene |
| G843 | 1268 | MISC (60-119, 270-350) | P5326 (floral meristem-expressed AP1 prom.) | P4559 | 4312 | Inc. lycopene |
| G865 | 1270 | AP2 (36-103) | P5297 (fruit tissue-expressed PG prom.) | P7088 | 4519 | Inc. brix |
| G865 | 1270 | AP2 (36-103) | P5318 (shoot apical meristem-expressed STM prom.) | P7088 | 4519 | Inc. brix |
| G865 | 1270 | AP2 (36-103) | P5319 (emergent leaf primordia-expressed AS1 prom.) | P7088 | 4519 | Inc. brix |
| G869 | 1272 | AP2 (110-165) | P5297 (fruit tissue-expressed PG prom.) | P9105 | 4781 | Inc. lycopene |
| G869 | 1272 | AP2 (110-165) | P5310 (root-expressed RSI1 prom.) | P9105 | 4781 | Inc. lycopene |
| G881 | 1274 | WRKY (176-233) | P5318 (shoot apical meristem-expressed STM prom.) | P5557 | 4397 | Inc. lycopene |
| G886 | 1276 | BZIPT2 (1-53, 542-652) | P5287 (epidermal tissue-expressed LTP1 prom.) | P6828 | 4477 | Inc. brix |
| G896 | 1278 | Z-LSDlike (18-39) | P5303 (fruit tissue-expressed PD prom.) | P7452 | 4548 | Inc. fruit weight |
| G896 | 1278 | Z-LSDlike (18-39) | P5284 (leaf-expressed RbcS3 prom.) | P7452 | 4548 | Inc. fruit weight |
| G896 | 1278 | Z-LSDlike (18-39) | P5297 (fruit tissue-expressed PG prom.) | P7452 | 4548 | Inc. fruit weight |
| G896 | 1278 | Z-LSDlike (18-39) | P5324 (fruit vascular tissue-expressed Cru prom.) | P7452 | 4548 | Inc. fruit weight |
| G896 | 1278 | Z-LSDlike (18-39) | P5287 (epidermal tissue-expressed LTP1 prom.) | P7452 | 4548 | Inc. fruit weight |
| G896 | 1278 | Z-LSDlike (18-39) | P5318 (shoot apical meristem-expressed STM prom.) | P7452 | 4548 | Inc. fruit weight |
| G897 | 1280 | Z-CO-like (8-39, 51-82) | P5318 (shoot apical meristem-expressed STM prom.) | P7085 | 4516 | Inc. lycopene |
| G902 | 1282 | Z-CO-like (NA) | P5319 (emergent leaf primordia-expressed AS1 prom.) | P9089 | 4777 | Inc. fruit weight |
| G902 | 1282 | Z-CO-like (NA) | P5324 (fruit vascular tissue-expressed Cru prom.) | P9089 | 4777 | Inc. fruit weight |
| G902 | 1282 | Z-CO-like (NA) | P5318 (shoot apical meristem-expressed STM prom.) | P9089 | 4777 | Inc. fruit weight |
| G904 | 1284 | RING/C3H2C3 (117-158) | P5318 (shoot apical meristem-expressed STM prom.) | P4748 | 4342 | Inc. lycopene |
| G905 | 1286 | RING/C3H2C3 (118-159) | P5318 (shoot apical meristem-expressed STM prom.) | P8548 | 4697 | Inc. brix |
| G910 | 1288 | Z-CO-like (14-37, 77-103) | P5297 (fruit tissue-expressed PG prom.) | P6867 | 4486 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G920 | 1290 | WRKY (152-211) | P5326 (floral meristem-expressed AP1 prom.) | P8941 | 4763 | Inc. lycopene |
| G921 | 1292 | WRKY (146-203) | P5287 (epidermal tissue-expressed LTP1 prom.) | P5826 | 4404 | Inc. lycopene |
| G927 | 1294 | CAAT (136-199) | P5284 (leaf-expressed RbcS3 prom.) | P6434 | 4451 | Inc. brix |
| G927 | 1294 | CAAT (136-199) | P5297 (fruit tissue-expressed PG prom.) | P6434 | 4451 | Inc. brix |
| G927 | 1294 | CAAT (136-199) | P5284 (leaf-expressed RbcS3 prom.) | P6434 | 4451 | Inc. lycopene |
| G927 | 1294 | CAAT (136-199) | P5297 (fruit tissue-expressed PG prom.) | P6434 | 4451 | Inc. lycopene |
| G929 | 1296 | CAAT (98-157) | P5324 (fruit vascular tissue-expressed Cru prom.) | P9107 | 4782 | Very high vigor |
| G934 | 1298 | ARF (NA) | P5326 (floral meristem-expressed AP1 prom.) | P8669 | 4737 | Inc. brix |
| G934 | 1298 | ARF (NA) | P5284 (leaf-expressed RbcS3 prom.) | P8669 | 4737 | Inc. lycopene |
| G936 | 1300 | GARP (59-107) | P5318 (shoot apical meristem-expressed STM prom.) | P7536 | 4575 | Inc. brix |
| G937 | 1302 | GARP (197-246) | P5324 (fruit vascular tissue-expressed Cru prom.) | P4527 | 4308 | Inc. fruit weight |
| G938 | 1304 | EIL (96-104) | P5310 (root-expressed RSI1 prom.) | | | Inc. lycopene |
| G939 | 1306 | EIL (97-106) | P5318 (shoot apical meristem-expressed STM prom.) | P3590 | 4196 | Inc. brix |
| G939 | 1306 | EIL (97-106) | P5318 (shoot apical meristem-expressed STM prom.) | P3590 | 4196 | Inc. lycopene |
| G941 | 1308 | EIL (95-103) | P5297 (fruit tissue-expressed PG prom.) | P5565 | 4398 | Inc. lycopene |
| G961 | 1310 | NAC (12-180) | P5326 (floral meristem-expressed AP1 prom.) | P8222 | 4663 | Inc. fruit weight |
| G961 | 1310 | NAC (12-180) | P5310 (root-expressed RSI1 prom.) | P8222 | 4663 | Inc. fruit weight |
| G962 | 1312 | NAC (53-175) | P5297 (fruit tissue-expressed PG prom.) | P6873 | 4488 | Inc. brix |
| G963 | 1314 | NAC (NA) | P5324 (fruit vascular tissue-expressed Cru prom.) | P4330 | 4279 | Inc. lycopene |
| G975 | 1316 | AP2 (4-71) | P5324 (fruit vascular tissue-expressed Cru prom.) | P3367 | 4179 | Inc. lycopene |
| G976 | 1318 | AP2 (87-153) | P5318 (shoot apical meristem-expressed STM prom.) | P3823 | 4216 | Inc. brix |
| G976 | 1318 | AP2 (87-153) | P5326 (floral meristem-expressed AP1 prom.) | P3823 | 4216 | Inc. brix |
| G976 | 1318 | AP2 (87-153) | P5287 (epidermal tissue-expressed LTP1 prom.) | P3823 | 4216 | Inc. brix |
| G979 | 1320 | AP2 (63-139, 165-233) | P5287 (epidermal tissue-expressed LTP1 prom.) | P3635 | 4205 | Inc. fruit weight |
| G988 | 1322 | SCR (150-217, 277-366, 371-444) | P5326 (floral meristem-expressed AP1 prom.) | P4204 | 4270 | Inc. brix |
| G991 | 1324 | IAA (7-14, 48-59, 82-115, 128-164) | P5297 (fruit tissue-expressed PG prom.) | P5703 | 4402 | Inc. lycopene |
| G993 | 1326 | AP2 (69-134, 191-290) | P5324 (fruit vascular tissue-expressed Cru prom.) | | | Deep red fruit |
| G997 | 1328 | MYB-related (9-59) | P5297 (fruit tissue-expressed PG prom.) | P7039 | 4505 | Inc. brix |
| G999 | 1330 | MYB-(R1)R2R3 (28-363) | P5297 (fruit tissue-expressed PG prom.) | P8150 | 4648 | Inc. lycopene |
| G1004 | 2 | AP2 (153-221) | P5297 (fruit tissue-expressed PG prom.) | P4764 | 4350 | Inc. fruit weight |
| G1006 | 4 | AP2 (113-177) | P5303 (fruit tissue-expressed PD prom.) | P7145 | 4533 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1006 | 4 | AP2 (113-177) | P5324 (fruit vascular tissue-expressed Cru prom.) | P7145 | 4533 | Inc. biomass |
| G1007 | 6 | AP2 (23-90) | P5326 (floral meristem-expressed AP1 prom.) | P4002 | 4243 | Inc. lycopene |
| G1008 | 8 | AP2 (96-163) | P5297 (fruit tissue-expressed PG prom.) | P7040 | 4506 | Inc. lycopene |
| G1014 | 10 | ABI3/VP-1 (90-172) | P5318 (shoot apical meristem-expressed STM prom.) | P9109 | 4783 | Inc. fruit weight |
| G1018 | 12 | ABI3/VP-1 (222-311) | P5318 (shoot apical meristem-expressed STM prom.) | P8584 | 4706 | Inc. fruit weight |
| G1021 | 14 | PMR (NA) | P5297 (fruit tissue-expressed PG prom.) | P4777 | 4356 | Inc. brix |
| G1021 | 14 | PMR (NA) | P5284 (leaf-expressed RbcS3 prom.) | P4777 | 4356 | Inc. lycopene |
| G1022 | 16 | WRKY (281-340) | P5318 (shoot apical meristem-expressed STM prom.) | P7865 | 4631 | Inc. fruit weight |
| G1033 | 18 | HMG (49-121) | P5326 (floral meristem-expressed AP1 prom.) | P7786 | 4615 | Inc. lycopene |
| G1048 | 20 | bZIP (138-190) | P5324 (fruit vascular tissue-expressed Cru prom.) | P6435 | 4452 | Inc. fruit weight |
| G1048 | 20 | bZIP (138-190) | P5326 (floral meristem-expressed AP1 prom.) | P6435 | 4452 | Inc. fruit weight |
| G1053 | 22 | bZIP (74-120) | P5318 (shoot apical meristem-expressed STM prom.) | P3599 | 4197 | Inc. lycopene |
| G1057 | 24 | bZIP (305-365) | P5284 (leaf-expressed RbcS3 prom.) | P6436 | 4453 | Inc. lycopene |
| G1062 | 26 | HLH/MYC (300-357) | P5303 (fruit tissue-expressed PD prom.) | P6854 | 4481 | Inc. brix |
| G1065 | 28 | DBP (101-210) | P5326 (floral meristem-expressed AP1 prom.) | P3579 | 4192 | Inc. fruit weight |
| G1067 | 30 | AT-hook (86-94, 95-246) | P5326 (floral meristem-expressed AP1 prom.) | P7832 | 4621 | Inc. brix |
| G1067 | 30 | AT-hook (86-94, 95-246) | P5326 (floral meristem-expressed AP1 prom.) | P7832 | 4621 | Inc. lycopene |
| G1067 | 30 | AT-hook (86-94, 95-246) | P5297 (fruit tissue-expressed PG prom.) | P7832 | 4621 | Inc. lycopene |
| G1072 | 32 | AT-hook (56-64, 123-238) | P5318 (shoot apical meristem-expressed STM prom.) | P6160 | 4427 | Inc. brix |
| G1076 | 34 | AT-hook (82-90, 91-233) | P5284 (leaf-expressed RbcS3 prom.) | P7092 | 4520 | Inc. lycopene |
| G1078 | 36 | BZIPT2 (1-53, 440-550) | P5284 (leaf-expressed RbcS3 prom.) | P3580 | 4193 | Inc. lycopene |
| G1080 | 38 | BZIPT2 (1-50) | P5297 (fruit tissue-expressed PG prom.) | P6453 | 4459 | Inc. brix |
| G1080 | 38 | BZIPT2 (1-50) | P5318 (shoot apical meristem-expressed STM prom.) | P6453 | 4459 | Inc. brix |
| G1080 | 38 | BZIPT2 (1-50) | P5287 (epidermal tissue-expressed LTP1 prom.) | P6453 | 4459 | Inc. lycopene |
| G1084 | 40 | BZIPT2 (1-53, 490-619) | P5318 (shoot apical meristem-expressed STM prom.) | P4779 | 4357 | Inc. lycopene |
| G1089 | 42 | BZIPT2 (425-500) | P5284 (leaf-expressed RbcS3 prom.) | P6421 | 4446 | Inc. brix |
| G1090 | 44 | AP2 (17-84) | P5318 (shoot apical meristem-expressed STM prom.) | P7093 | 4521 | Inc. brix |
| G1091 | 46 | WRKY (262-319) | P5318 (shoot apical meristem-expressed STM prom.) | | | Inc. fruit weight |
| G1091 | 46 | WRKY (262-319) | P5284 (leaf-expressed RbcS3 prom.) | | | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1098 | 48 | RING/C3H2C3 (10-29, 190-230, 255-262, 286-290) | P5326 (floral meristem-expressed AP1 prom.) | P8230 | 4667 | Inc. fruit weight |
| G1098 | 48 | RING/C3H2C3 (10-29, 190-230, 255-262, 286-290) | P5297 (fruit tissue-expressed PG prom.) | P8230 | 4667 | Inc. fruit weight |
| G1113 | 50 | RING/C3H2C3 (85-128) | P5310 (root-expressed RSI1 prom.) | P8232 | 4668 | Inc. lycopene |
| G1113 | 50 | RING/C3H2C3 (85-128) | P5297 (fruit tissue-expressed PG prom.) | P8232 | 4668 | Inc. fruit weight |
| G1127 | 52 | AT-hook (102-110, 155-162, 180-295) | P5297 (fruit tissue-expressed PG prom.) | P4185 | 4264 | Inc. fruit weight |
| G1131 | 54 | HLH/MYC (160-217) | P5297 (fruit tissue-expressed PG prom.) | P3950 | 4225 | Inc. lycopene |
| G1131 | 54 | HLH/MYC (160-217) | P5326 (floral meristem-expressed AP1 prom.) | P3950 | 4225 | Inc. fruit weight |
| G1133 | 56 | HLH/MYC (260-317) | P5319 (emergent leaf primordia-expressed AS1 prom.) | P7148 | 4534 | Inc. brix |
| G1134 | 58 | HLH/MYC (187-245) | P6506 (constitutive CaMv 35S prom.) | P7112 | 4525 | Inc. brix |
| G1136 | 60 | HLH/MYC (408-465) | P5287 (epidermal tissue-expressed LTP1 prom.) | P7769 | 4609 | Inc. fruit weight |
| G1137 | 62 | HLH/MYC (257-314) | P5297 (fruit tissue-expressed PG prom.) | P3410 | 4184 | Inc. brix |
| G1140 | 64 | MADS (2-57) | P5326 (floral meristem-expressed AP1 prom.) | P4765 | 4351 | Inc. brix |
| G1141 | 66 | AP2 (75-142) | P5284 (leaf-expressed RbcS3 prom.) | P7149 | 4535 | Inc. brix |
| G1141 | 66 | AP2 (75-142) | P5326 (floral meristem-expressed AP1 prom.) | P7149 | 4535 | Inc. brix |
| G1141 | 66 | AP2 (75-142) | P5319 (emergent leaf primordia-expressed AS1 prom.) | P7149 | 4535 | Inc. brix |
| G1141 | 66 | AP2 (75-142) | P5297 (fruit tissue-expressed PG prom.) | P7149 | 4535 | Inc. lycopene |
| G1141 | 66 | AP2 (75-142) | P5319 (emergent leaf primordia-expressed AS1 prom.) | P7149 | 4535 | Inc. lycopene |
| G1146 | 68 | PAZ (886-896) | P6506 (constitutive CaMv 35S prom.) | P7061 | 4509 | Inc. brix |
| G1146 | 68 | PAZ (886-896) | P5297 (fruit tissue-expressed PG prom.) | P7061 | 4509 | Inc. brix |
| G1148 | 70 | PAZ (770-807) | P5318 (shoot apical meristem-expressed STM prom.) | P8627 | 4723 | Inc. fruit weight |
| G1148 | 70 | PAZ (770-807) | P5326 (floral meristem-expressed AP1 prom.) | P8627 | 4723 | Inc. fruit weight |
| G1150 | 72 | PAZ (887-907) | P5287 (epidermal tissue-expressed LTP1 prom.) | | | Inc. lycopene |
| G1198 | 74 | bZIP (173-223) | P5287 (epidermal tissue-expressed LTP1 prom.) | P4766 | 4352 | Inc. fruit weight |
| G1211 | 76 | MISC (123-179) | P5297 (fruit tissue-expressed PG prom.) | P6173 | 4430 | Inc. brix |
| G1211 | 76 | MISC (123-179) | P5319 (emergent leaf primordia-expressed AS1 prom.) | P6173 | 4430 | Inc. brix |
| G1211 | 76 | MISC (123-179) | P5324 (fruit vascular tissue-expressed Cru prom.) | P6173 | 4430 | Inc. brix |
| G1216 | 78 | BPF-1 (293-373, 464-550) | P5297 (fruit tissue-expressed PG prom.) | P7850 | 4624 | Inc. fruit weight |
| G1226 | 80 | HLH/MYC (109-168) | P5284 (leaf-expressed RbcS3 prom.) | P3647 | 4208 | Inc. lycopene |
| G1228 | 82 | HLH/MYC (172-231) | P5326 (floral meristem-expressed AP1 prom.) | P3411 | 4185 | Inc. lycopene |
| G1228 | 82 | HLH/MYC (172-231) | P5297 (fruit tissue-expressed PG prom.) | P3411 | 4185 | Inc. lycopene |
| G1231 | 84 | Z-C4HC3 (201-249) | P5318 (shoot apical meristem-expressed STM prom.) | P7870 | 4634 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1233 | 86 | Z-C4HC3 (192-240) | P5318 (shoot apical meristem-expressed STM prom.) | P7152 | 4536 | Inc. lycopene |
| G1240 | 88 | MISC (NA) | P5318 (shoot apical meristem-expressed STM prom.) | P7153 | 4537 | Inc. brix |
| G1240 | 88 | MISC (NA) | P5297 (fruit tissue-expressed PG prom.) | P7153 | 4537 | Inc. brix |
| G1243 | 90 | SWI/SNF (185-377, 520-604, 842-891, 944-1005) | P5326 (floral meristem-expressed AP1 prom.) | P3998 | 4242 | Inc. fruit weight |
| G1246 | 92 | MYB-(R1)R2R3 (27-139) | P5303 (fruit tissue-expressed PD prom.) | P6062 | 4423 | Inc. fruit weight |
| G1247 | 94 | MYB-(R1)R2R3 (18-141) | P5318 (shoot apical meristem-expressed STM prom.) | P7737 | 4599 | Inc. lycopene |
| G1249 | 96 | CAAT (13-89) | P5318 (shoot apical meristem-expressed STM prom.) | P3993 | 4240 | Inc. brix |
| G1256 | 98 | Z-C2H2 (67-87, 143-163) | P5287 (epidermal tissue-expressed LTP1 prom.) | P8611 | 4715 | Inc. fruit weight |
| G1266 | 100 | AP2 (79-147) | P5303 (fruit tissue-expressed PD prom.) | P7154 | 4538 | Inc. brix |
| G1272 | 102 | PAZ (800-837) | P5297 (fruit tissue-expressed PG prom.) | P4181 | 4263 | Inc. lycopene |
| G1273 | 104 | WRKY (163-218, 347-403) | P5326 (floral meristem-expressed AP1 prom.) | P3994 | 4241 | Inc. lycopene |
| G1274 | 106 | WRKY (110-166) | P5297 (fruit tissue-expressed PG prom.) | P8239 | 4675 | Inc. brix |
| G1275 | 108 | WRKY (113-169) | P5287 (epidermal tissue-expressed LTP1 prom.) | P3412 | 4186 | Inc. lycopene |
| G1278 | 110 | bZIP (230-328) | P5284 (leaf-expressed RbcS3 prom.) | P4780 | 4358 | Inc. lycopene |
| G1293 | 112 | AKR (NA) | P5318 (shoot apical meristem-expressed STM prom.) | P9114 | 4784 | Inc. fruit weight |
| G1293 | 112 | AKR (NA) | P5297 (fruit tissue-expressed PG prom.) | P9114 | 4784 | Inc. fruit weight |
| G1293 | 112 | AKR (NA) | P6506 (constitutive CaMv 35S prom.) | P9114 | 4784 | More trichomes |
| G1297 | 114 | ENBP (77-124, 480-795) | P5297 (fruit tissue-expressed PG prom.) | P8552 | 4698 | Inc. fruit weight |
| G1303 | 116 | Z-C4HC3 (187-235) | P5284 (leaf-expressed RbcS3 prom.) | P7871 | 4635 | Inc. brix |
| G1303 | 116 | Z-C4HC3 (187-235) | P5318 (shoot apical meristem-expressed STM prom.) | P7871 | 4635 | Inc. brix |
| G1303 | 116 | Z-C4HC3 (187-235) | P5284 (leaf-expressed RbcS3 prom.) | P7871 | 4635 | Inc. lycopene |
| G1305 | 118 | MYB-(R1)R2R3 (15-118) | P5326 (floral meristem-expressed AP1 prom.) | P6207 | 4437 | Inc. brix |
| G1308 | 120 | MYB-(R1)R2R3 (1-128) | P5287 (epidermal tissue-expressed LTP1 prom.) | P3830 | 4217 | Inc. fruit weight |
| G1309 | 122 | MYB-(R1)R2R3 (13-115) | P5297 (fruit tissue-expressed PG prom.) | P3413 | 4187 | Inc. lycopene |
| G1309 | 122 | MYB-(R1)R2R3 (13-115) | P5287 (epidermal tissue-expressed LTP1 prom.) | P3413 | 4187 | Inc. fruit weight |
| G1313 | 124 | MYB-(R1)R2R3 (32-135) | P5297 (fruit tissue-expressed PG prom.) | P7462 | 4552 | Inc. lycopene |
| G1313 | 124 | MYB-(R1)R2R3 (32-135) | P5326 (floral meristem-expressed AP1 prom.) | P7462 | 4552 | Inc. fruit weight |
| G1315 | 126 | MYB-(R1)R2R3 (14-115) | P5326 (floral meristem-expressed AP1 prom.) | P3832 | 4218 | Inc. fruit weight |
| G1319 | 128 | MYB-(R1)R2R3 (14-114) | P5318 (shoot apical meristem-expressed STM prom.) | P4020 | 4246 | Inc. fruit weight |
| G1320 | 130 | MYB-(R1)R2R3 (5-108) | P5287 (epidermal tissue-expressed LTP1 prom.) | P3834 | 4219 | Inc. brix |
| G1324 | 132 | MYB-(R1)R2R3 (20-118) | P5297 (fruit tissue-expressed PG prom.) | P4914 | 4364 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1326 | 134 | MYB-(R1)R2R3 (18-121) | P5287 (epidermal tissue-expressed LTP1 prom.) | P3417 | 4188 | Inc. fruit weight |
| G1335 | 136 | Z-CLDSH (24-43, 131-144, 185-203) | P6506 (constitutive CaMv 35S prom.) | P5689 | 4399 | Inc. brix |
| G1335 | 136 | Z-CLDSH (24-43, 131-144, 185-203) | P5326 (floral meristem-expressed AP1 prom.) | P5689 | 4399 | Inc. brix |
| G1341 | 138 | BZIPT2 (1-34, 288-398) | P5287 (epidermal tissue-expressed LTP1 prom.) | P8628 | 4724 | Inc. lycopene |
| G1349 | 140 | Z-LSDlike (6-39) | P5287 (epidermal tissue-expressed LTP1 prom.) | P5692 | 4400 | Inc. brix |
| G1349 | 140 | Z-LSDlike (6-39) | P5319 (emergent leaf primordia-expressed AS1 prom.) | P5692 | 4400 | Inc. brix |
| G1349 | 140 | Z-LSDlike (6-39) | P5324 (fruit vascular tissue-expressed Cru prom.) | P5692 | 4400 | Inc. brix |
| G1349 | 140 | Z-LSDlike (6-39) | P5324 (fruit vascular tissue-expressed Cru prom.) | P5692 | 4400 | Inc. lycopene |
| G1352 | 142 | Z-C2H2 (108-129, 167-188) | P5310 (root-expressed RSI1 prom.) | P9257 | 4818 | Inc. lycopene |
| G1352 | 142 | Z-C2H2 (108-129, 167-188) | P5287 (epidermal tissue-expressed LTP1 prom.) | P9257 | 4818 | Inc. fruit weight |
| G1354 | 144 | NAC (7-157) | P5297 (fruit tissue-expressed PG prom.) | P3976 | 4235 | Inc. brix |
| G1354 | 144 | NAC (7-157) | P5326 (floral meristem-expressed AP1 prom.) | P3976 | 4235 | Inc. brix |
| G1354 | 144 | NAC (7-157) | P5318 (shoot apical meristem-expressed STM prom.) | P3976 | 4235 | Inc. brix |
| G1354 | 144 | NAC (7-157) | P5310 (root-expressed RSI1 prom.) | P3976 | 4235 | Inc. lycopene |
| G1355 | 146 | NAC (9-159) | P5287 (epidermal tissue-expressed LTP1 prom.) | P7864 | 4630 | Inc. fruit weight |
| G1361 | 148 | NAC (59-200) | P5297 (fruit tissue-expressed PG prom.) | P7770 | 4610 | Inc. brix |
| G1361 | 148 | NAC (59-200) | P5326 (floral meristem-expressed AP1 prom.) | P7770 | 4610 | Inc. brix |
| G1364 | 150 | CAAT (29-118) | P5287 (epidermal tissue-expressed LTP1 prom.) | P4357 | 4286 | Inc. fruit weight |
| G1367 | 152 | AT-hook (179-201, 262-285, 298-319, 335-357) | P5297 (fruit tissue-expressed PG prom.) | P7184 | 4544 | Inc. lycopene |
| G1379 | 156 | AP2 (18-85) | P5319 (emergent leaf primordia-expressed AS1 prom.) | P6858 | 4483 | Inc. brix |
| G1379 | 156 | AP2 (18-85) | P5318 (shoot apical meristem-expressed STM prom.) | P6858 | 4483 | Inc. brix |
| G1379 | 156 | AP2 (18-85) | P5326 (floral meristem-expressed AP1 prom.) | P6858 | 4483 | Inc. brix |
| G1379 | 156 | AP2 (18-85) | P5297 (fruit tissue-expressed PG prom.) | P6858 | 4483 | Inc. brix |
| G1382 | 160 | WRKY (210-266, 385-437) | P5326 (floral meristem-expressed AP1 prom.) | P9268 | 4821 | Inc. fruit weight |
| G1382 | 160 | WRKY (210-266, 385-437) | P5287 (epidermal tissue-expressed LTP1 prom.) | P9268 | 4821 | Inc. fruit weight |
| G1382 | 160 | WRKY (210-266, 385-437) | P5318 (shoot apical meristem-expressed STM prom.) | P9268 | 4821 | Inc. fruit weight |
| G1384 | 162 | AP2 (127-194) | P5297 (fruit tissue-expressed PG prom.) | P7479 | 4559 | Inc. brix |
| G1384 | 162 | AP2 (127-194) | P5284 (leaf-expressed RbcS3 prom.) | P7479 | 4559 | Inc. brix |
| G1389 | 164 | TEO (30-87) | P5318 (shoot apical meristem-expressed STM prom.) | P6866 | 4485 | Inc. brix |
| G1394 | 168 | S1FA (13-63) | P5287 (epidermal tissue-expressed LTP1 prom.) | P6857 | 4482 | Inc. brix |
| G1394 | 168 | S1FA (13-63) | P6506 (constitutive CaMv 35S prom.) | P6857 | 4482 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1395 | 170 | S1FA (1-72) | P5284 (leaf-expressed RbcS3 prom.) | P7157 | 4539 | Inc. fruit weight |
| G1403 | 174 | GF14 (16-61) | P5326 (floral meristem-expressed AP1 prom.) | | | Inc. lycopene |
| G1410 | 176 | HS (206-298) | P5287 (epidermal tissue-expressed LTP1 prom.) | P4771 | 4353 | Inc. fruit weight |
| G1419 | 178 | AP2 (69-137) | P6506 (constitutive CaMv 35S prom.) | P3616 | 4201 | Inc. lycopene |
| G1421 | 180 | AP2 (84-146) | P5326 (floral meristem-expressed AP1 prom.) | P3631 | 4204 | Inc. brix |
| G1421 | 180 | AP2 (84-146) | P5319 (emergent leaf primordia-expressed AS1 prom.) | P3631 | 4204 | Inc. brix |
| G1421 | 180 | AP2 (84-146) | P5287 (epidermal tissue-expressed LTP1 prom.) | P3631 | 4204 | Inc. brix |
| G1421 | 180 | AP2 (84-146) | P5297 (fruit tissue-expressed PG prom.) | P3631 | 4204 | Inc. brix |
| G1421 | 180 | AP2 (84-146) | P5318 (shoot apical meristem-expressed STM prom.) | P3631 | 4204 | Inc. brix |
| G1421 | 180 | AP2 (84-146) | P5287 (epidermal tissue-expressed LTP1 prom.) | P3631 | 4204 | Inc. lycopene |
| G1421 | 180 | AP2 (84-146) | P5324 (fruit vascular tissue-expressed Cru prom.) | P3631 | 4204 | Inc. lycopene |
| G1421 | 180 | AP2 (84-146) | P5303 (fruit tissue-expressed PD prom.) | P3631 | 4204 | Inc. lycopene |
| G1421 | 180 | AP2 (84-146) | P5284 (leaf-expressed RbcS3 prom.) | P3631 | 4204 | Inc. lycopene |
| G1421 | 180 | AP2 (84-146) | P5297 (fruit tissue-expressed PG prom.) | P3631 | 4204 | Inc. lycopene |
| G1421 | 180 | AP2 (84-146) | P5319 (emergent leaf primordia-expressed AS1 prom.) | P3631 | 4204 | Inc. lycopene |
| G1421 | 180 | AP2 (84-146) | P5318 (shoot apical meristem-expressed STM prom.) | P3631 | 4204 | Inc. lycopene |
| G1423 | 182 | MADS (6-62) | P6506 (constitutive CaMv 35S prom.) | P7511 | 4567 | Inc. brix |
| G1435 | 184 | GARP (146-194) | P5326 (floral meristem-expressed AP1 prom.) | P9116 | 4785 | Inc. fruit weight |
| G1437 | 186 | GRF-like (59-150) | P5303 (fruit tissue-expressed PD prom.) | P4918 | 4365 | Inc. fruit weight |
| G1437 | 186 | GRF-like (59-150) | P5287 (epidermal tissue-expressed LTP1 prom.) | P4918 | 4365 | Inc. fruit weight |
| G1437 | 186 | GRF-like (59-150) | P5297 (fruit tissue-expressed PG prom.) | P4918 | 4365 | Inc. fruit weight |
| G1438 | 188 | GRF-like (16-124) | P6506 (constitutive CaMv 35S prom.) | P3840 | 4220 | Larger leaflets |
| G1439 | 190 | GRF-like (133-239) | P5284 (leaf-expressed RbcS3 prom.) | P6019 | 4415 | Inc. lycopene |
| G1442 | 192 | GRF-like (111-223) | P6506 (constitutive CaMv 35S prom.) | P6050 | 4419 | Large light green leaves |
| G1442 | 192 | GRF-like (111-223) | P6506 (constitutive CaMv 35S prom.) | P6050 | 4419 | Rugulose leaves (small wrinkles) |
| G1443 | 194 | GRF-like (24-132) | P5284 (leaf-expressed RbcS3 prom.) | P3841 | 4221 | Inc. fruit weight |
| G1451 | 198 | ARF (22-357) | P5319 (emergent leaf primordia-expressed AS1 prom.) | P8610 | 4714 | Inc. fruit weight |
| G1451 | 198 | ARF (22-357) | P5318 (shoot apical meristem-expressed STM prom.) | P8610 | 4714 | Inc. fruit weight |
| G1451 | 198 | ARF (22-357) | P5287 (epidermal tissue-expressed LTP1 prom.) | P8610 | 4714 | Inc. fruit weight |
| G1456 | 200 | NAC (NA) | P5318 (shoot apical meristem-expressed STM prom.) | P3978 | 4236 | Inc. fruit weight |
| G1460 | 204 | NAC (NA) | P5284 (leaf-expressed RbcS3 prom.) | P4946 | 4367 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1462 | 206 | NAC (14-273) | P5326 (floral meristem-expressed AP1 prom.) | P4336 | 4280 | Inc. lycopene |
| G1469 | 208 | Z-C2H2 (11-31, 230-250, 276-296) | P5297 (fruit tissue-expressed PG prom.) | P8615 | 4717 | Inc. fruit weight |
| G1469 | 208 | Z-C2H2 (11-31, 230-250, 276-296) | P5318 (shoot apical meristem-expressed STM prom.) | P8615 | 4717 | Inc. fruit weight |
| G1469 | 208 | Z-C2H2 (11-31, 230-250, 276-296) | P5326 (floral meristem-expressed AP1 prom.) | P8615 | 4717 | Inc. fruit weight |
| G1469 | 208 | Z-C2H2 (11-31, 230-250, 276-296) | P5287 (epidermal tissue-expressed LTP1 prom.) | P8615 | 4717 | Inc. fruit weight |
| G1471 | 210 | Z-C2H2 (49-70) | P5297 (fruit tissue-expressed PG prom.) | P4375 | 4292 | Inc. fruit weight |
| G1471 | 210 | Z-C2H2 (49-70) | P5287 (epidermal tissue-expressed LTP1 prom.) | P4375 | 4292 | Inc. fruit weight |
| G1474 | 212 | Z-C2H2 (41-68) | P5319 (emergent leaf primordia-expressed AS1 prom.) | P7456 | 4549 | Inc. fruit weight |
| G1474 | 212 | Z-C2H2 (41-68) | P5324 (fruit vascular tissue-expressed Cru prom.) | P7456 | 4549 | Thick stems |
| G1478 | 214 | Z-CO-like (32-76) | P5318 (shoot apical meristem-expressed STM prom.) | P4378 | 4293 | Inc. brix |
| G1480 | 218 | Z-CO-like (50-73, 92-116) | P5326 (floral meristem-expressed AP1 prom.) | P5883 | 4408 | Inc. fruit weight |
| G1487 | 220 | GATA/Zn (251-276) | P5287 (epidermal tissue-expressed LTP1 prom.) | P9266 | 4819 | Inc. fruit weight |
| G1487 | 220 | GATA/Zn (251-276) | P5284 (leaf-expressed RbcS3 prom.) | P9266 | 4819 | Inc. fruit weight |
| G1487 | 220 | GATA/Zn (251-276) | P5318 (shoot apical meristem-expressed STM prom.) | P9266 | 4819 | Inc. fruit weight |
| G1488 | 222 | GATA/Zn (221-246) | P5287 (epidermal tissue-expressed LTP1 prom.) | P9267 | 4820 | Inc. fruit weight |
| G1488 | 222 | GATA/Zn (221-246) | P5297 (fruit tissue-expressed PG prom.) | P9267 | 4820 | Inc. fruit weight |
| G1488 | 222 | GATA/Zn (221-246) | P5284 (leaf-expressed RbcS3 prom.) | P9267 | 4820 | Inc. fruit weight |
| G1491 | 224 | GARP (50-100) | P5287 (epidermal tissue-expressed LTP1 prom.) | P4583 | 4317 | Inc. lycopene |
| G1494 | 226 | HLH/MYC (254-311) | P5284 (leaf-expressed RbcS3 prom.) | P4772 | 4354 | Inc. lycopene |
| G1498 | 228 | HLH/MYC (281-338) | P5284 (leaf-expressed RbcS3 prom.) | P3952 | 4226 | Inc. brix |
| G1498 | 228 | HLH/MYC (281-338) | P5326 (floral meristem-expressed AP1 prom.) | P3952 | 4226 | Inc. brix |
| G1505 | 232 | GATA/Zn (NA) | P5318 (shoot apical meristem-expressed STM prom.) | P4414 | 4303 | Inc. lycopene |
| G1506 | 234 | GATA/Zn (7-33) | P5287 (epidermal tissue-expressed LTP1 prom.) | P4024 | 4248 | Inc. fruit weight |
| G1506 | 234 | GATA/Zn (7-33) | P5297 (fruit tissue-expressed PG prom.) | P4024 | 4248 | Inc. fruit weight |
| G1510 | 236 | GATA/Zn (230-263) | P5297 (fruit tissue-expressed PG prom.) | P8244 | 4677 | Inc. lycopene |
| G1517 | 238 | RING/C3HC4 (312-349) | P5310 (root-expressed RSI1 prom.) | P9147 | 4798 | Inc. lycopene |
| G1518 | 240 | RING/C3HC4 (51-93, 126-209, 374-670) | P5287 (epidermal tissue-expressed LTP1 prom.) | P6449 | 4457 | Inc. brix |
| G1518 | 240 | RING/C3HC4 (51-93, 126-209, 374-670) | P5324 (fruit vascular tissue-expressed Cru prom.) | P6449 | 4457 | Inc. fruit weight |
| G1521 | 242 | RING/C3HC4 (39-80) | P5310 (root-expressed RSI1 prom.) | P3652 | 4211 | Inc. brix |
| G1521 | 242 | RING/C3HC4 (39-80) | P5310 (root-expressed RSI1 prom.) | P3652 | 4211 | Inc. lycopene |
| G1527 | 244 | RING/C3HC4 (129-166) | P5326 (floral meristem-expressed AP1 prom.) | P9146 | 4797 | Inc. fruit weight |
| G1530 | 246 | RING/C3H2C3 (102-144) | P5287 (epidermal tissue-expressed LTP1 prom.) | P8233 | 4669 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1530 | 246 | RING/C3H2C3 (102-144) | P5319 (emergent leaf primordia-expressed AS1 prom.) | P8233 | 4669 | Inc. fruit weight |
| G1530 | 246 | RING/C3H2C3 (102-144) | P5318 (shoot apical meristem-expressed STM prom.) | P8233 | 4669 | Inc. fruit weight |
| G1530 | 246 | RING/C3H2C3 (102-144) | P5297 (fruit tissue-expressed PG prom.) | P8233 | 4669 | Inc. fruit weight |
| G1531 | 248 | RING/C3HC4 (41-77) | P5284 (leaf-expressed RbcS3 prom.) | P6473 | 4466 | Inc. brix |
| G1531 | 248 | RING/C3HC4 (41-77) | P5324 (fruit vascular tissue-expressed Cru prom.) | P6473 | 4466 | Inc. brix |
| G1531 | 248 | RING/C3HC4 (41-77) | P5297 (fruit tissue-expressed PG prom.) | P6473 | 4466 | Inc. brix |
| G1535 | 250 | HB (109-169) | P5287 (epidermal tissue-expressed LTP1 prom.) | P8616 | 4718 | Inc. brix |
| G1538 | 252 | HB (66-126) | P5287 (epidermal tissue-expressed LTP1 prom.) | P3968 | 4231 | Inc. lycopene |
| G1540 | 256 | HB (35-98) | P5326 (floral meristem-expressed AP1 prom.) | P3423 | 4189 | Inc. fruit weight |
| G1540 | 256 | HB (35-98) | P5318 (shoot apical meristem-expressed STM prom.) | P3423 | 4189 | Inc. fruit weight |
| G1543 | 258 | HB (135-195) | P5284 (leaf-expressed RbcS3 prom.) | P3424 | 4190 | Inc. brix |
| G1543 | 258 | HB (135-195) | P5284 (leaf-expressed RbcS3 prom.) | P3424 | 4190 | Inc. lycopene |
| G1549 | 260 | HB (75-135) | P5287 (epidermal tissue-expressed LTP1 prom.) | P7720 | 4595 | Inc. fruit weight |
| G1550 | 262 | HB (NA) | P5319 (emergent leaf primordia-expressed AS1 prom.) | P3970 | 4232 | Inc. brix |
| G1551 | 264 | HB (99-160) | P5319 (emergent leaf primordia-expressed AS1 prom.) | P4575 | 4316 | Inc. lycopene |
| G1551 | 264 | HB (99-160) | P5284 (leaf-expressed RbcS3 prom.) | P4575 | 4316 | Inc. fruit weight |
| G1553 | 266 | ARF (20-351) | P5284 (leaf-expressed RbcS3 prom.) | P9057 | 4771 | Inc. fruit weight |
| G1553 | 266 | ARF (20-351) | P5326 (floral meristem-expressed AP1 prom.) | P9057 | 4771 | Inc. fruit weight |
| G1553 | 266 | ARF (20-351) | P5318 (shoot apical meristem-expressed STM prom.) | P9057 | 4771 | Inc. fruit weight |
| G1553 | 266 | ARF (20-351) | P5287 (epidermal tissue-expressed LTP1 prom.) | P9057 | 4771 | Inc. fruit weight |
| G1559 | 268 | TH (55-154) | P5287 (epidermal tissue-expressed LTP1 prom.) | P7788 | 4617 | Inc. brix |
| G1559 | 268 | TH (55-154) | P5297 (fruit tissue-expressed PG prom.) | P7788 | 4617 | Inc. lycopene |
| G1559 | 268 | TH (55-154) | P5287 (epidermal tissue-expressed LTP1 prom.) | P7788 | 4617 | Inc. lycopene |
| G1592 | 276 | HB (NA) | P5326 (floral meristem-expressed AP1 prom.) | P4153 | 4257 | Inc. fruit weight |
| G1592 | 276 | HB (NA) | P5318 (shoot apical meristem-expressed STM prom.) | P4153 | 4257 | Inc. fruit weight |
| G1634 | 278 | MYB-related (29-79, 131-179) | P5287 (epidermal tissue-expressed LTP1 prom.) | P7863 | 4629 | Inc. brix |
| G1635 | 280 | MYB-related (56-102) | P5318 (shoot apical meristem-expressed STM prom.) | P3606 | 4200 | Inc. lycopene |
| G1635 | 280 | MYB-related (56-102) | P5287 (epidermal tissue-expressed LTP1 prom.) | P3606 | 4200 | Inc. lycopene |
| G1637 | 282 | MYB-related (108-156) | P5318 (shoot apical meristem-expressed STM prom.) | P6168 | 4429 | Inc. brix |
| G1638 | 284 | MYB-related (27-77, 141-189) | P5297 (fruit tissue-expressed PG prom.) | P3843 | 4222 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1640 | 286 | MYB-(R1)R2R3 (14-115) | P5324 (fruit vascular tissue-expressed Cru prom.) | P3604 | 4199 | Inc. lycopene |
| G1642 | 288 | MYB-(R1)R2R3 (NA) | P5324 (fruit vascular tissue-expressed Cru prom.) | P6893 | 4494 | Inc. fruit weight |
| G1646 | 290 | CAAT (66-162) | P5297 (fruit tissue-expressed PG prom.) | P7118 | 4526 | Inc. fruit weight |
| G1656 | 294 | HLH/MYC (112-169) | P5326 (floral meristem-expressed AP1 prom.) | P4156 | 4258 | Inc. lycopene |
| G1657 | 296 | DBP (56-97, 149-268) | P5319 (emergent leaf primordia-expressed AS1 prom.) | P6184 | 4432 | Inc. fruit weight |
| G1659 | 298 | DBP (17-116) | P5319 (emergent leaf primordia-expressed AS1 prom.) | P4594 | 4320 | Inc. lycopene |
| G1659 | 298 | DBP (17-116) | P5318 (shoot apical meristem-expressed STM prom.) | P4594 | 4320 | Inc. lycopene |
| G1659 | 298 | DBP (17-116) | P5324 (fruit vascular tissue-expressed Cru prom.) | P4594 | 4320 | Inc. lycopene |
| G1660 | 302 | DBP (362-476) | P5297 (fruit tissue-expressed PG prom.) | | | Inc. fruit weight |
| G1660 | 302 | DBP (362-476) | P5284 (leaf-expressed RbcS3 prom.) | | | Inc. fruit weight |
| G1660 | 302 | DBP (362-476) | P5326 (floral meristem-expressed AP1 prom.) | | | Inc. fruit weight |
| G1665 | 304 | HLH/MYC (NA) | P5297 (fruit tissue-expressed PG prom.) | P4186 | 4265 | Inc. lycopene |
| G1666 | 306 | HLH/MYC (356-413) | P5318 (shoot apical meristem-expressed STM prom.) | P4595 | 4321 | Inc. fruit weight |
| G1666 | 306 | HLH/MYC (356-413) | P5284 (leaf-expressed RbcS3 prom.) | P4595 | 4321 | More anthocyanin |
| G1669 | 308 | Z-CO-like (NA) | P5287 (epidermal tissue-expressed LTP1 prom.) | P5702 | 4401 | Inc. brix |
| G1670 | 312 | NAC (15-198) | P5326 (floral meristem-expressed AP1 prom.) | P4340 | 4281 | Inc. fruit weight |
| G1730 | 316 | RING/C3H2C3 (103-144) | P5287 (epidermal tissue-expressed LTP1 prom.) | P8234 | 4670 | Inc. brix |
| G1730 | 316 | RING/C3H2C3 (103-144) | P5297 (fruit tissue-expressed PG prom.) | P8234 | 4670 | Inc. brix |
| G1730 | 316 | RING/C3H2C3 (103-144) | P5284 (leaf-expressed RbcS3 prom.) | P8234 | 4670 | Inc. lycopene |
| G1730 | 316 | RING/C3H2C3 (103-144) | P5287 (epidermal tissue-expressed LTP1 prom.) | P8234 | 4670 | Inc. lycopene |
| G1736 | 318 | RING/C3H2C3 (139-179) | P5297 (fruit tissue-expressed PG prom.) | P8235 | 4671 | Inc. lycopene |
| G1736 | 318 | RING/C3H2C3 (139-179) | P5284 (leaf-expressed RbcS3 prom.) | P8235 | 4671 | Inc. lycopene |
| G1750 | 320 | AP2 (115-177) | P5284 (leaf-expressed RbcS3 prom.) | P3963 | 4229 | Inc. brix |
| G1750 | 320 | AP2 (115-177) | P5287 (epidermal tissue-expressed LTP1 prom.) | P3963 | 4229 | Inc. brix |
| G1750 | 320 | AP2 (115-177) | P5319 (emergent leaf primordia-expressed AS1 prom.) | P3963 | 4229 | Inc. lycopene |
| G1750 | 320 | AP2 (115-177) | P5324 (fruit vascular tissue-expressed Cru prom.) | P3963 | 4229 | Inc. lycopene |
| G1751 | 322 | AP2 (133-200) | P5318 (shoot apical meristem-expressed STM prom.) | P4207 | 4272 | Inc. brix |
| G1751 | 322 | AP2 (133-200) | P5284 (leaf-expressed RbcS3 prom.) | P4207 | 4272 | Inc. lycopene |
| G1751 | 322 | AP2 (133-200) | P5297 (fruit tissue-expressed PG prom.) | P4207 | 4272 | Inc. leaf dissection |
| G1751 | 322 | AP2 (133-200) | P5297 (fruit tissue-expressed PG prom.) | P4207 | 4272 | Pale white fruit at green stage |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1752 | 324 | AP2 (83-151) | P5287 (epidermal tissue-expressed LTP1 prom.) | P4390 | 4295 | Inc. fruit weight |
| G1755 | 326 | AP2 (71-133) | P5303 (fruit tissue-expressed PD prom.) | P4407 | 4302 | Inc. lycopene |
| G1757 | 328 | WRKY (158-218) | P6506 (constitutive CaMv 35S prom.) | P6412 | 4442 | Inc. brix |
| G1757 | 328 | WRKY (158-218) | P5303 (fruit tissue-expressed PD prom.) | P6412 | 4442 | Inc. brix |
| G1757 | 328 | WRKY (158-218) | P5284 (leaf-expressed RbcS3 prom.) | P6412 | 4442 | Inc. brix |
| G1758 | 330 | WRKY (109-165) | P5318 (shoot apical meristem-expressed STM prom.) | P9153 | 4800 | Inc. fruit weight |
| G1758 | 330 | WRKY (109-165) | P5326 (floral meristem-expressed AP1 prom.) | P9153 | 4800 | Inc. fruit weight |
| G1758 | 330 | WRKY (109-165) | P5287 (epidermal tissue-expressed LTP1 prom.) | P9153 | 4800 | Inc. fruit weight |
| G1759 | 332 | MADS (2-57) | P5297 (fruit tissue-expressed PG prom.) | P4147 | 4256 | Inc. brix |
| G1760 | 334 | MADS (2-57) | P5318 (shoot apical meristem-expressed STM prom.) | P3371 | 4180 | Inc. fruit weight |
| G1763 | 336 | AP2 (140-207) | P5303 (fruit tissue-expressed PD prom.) | P7165 | 4542 | Inc. fruit weight |
| G1765 | 338 | NAC (20-140) | P5297 (fruit tissue-expressed PG prom.) | P4343 | 4283 | Inc. brix |
| G1767 | 340 | SCR (225-290, 355-450, 453-528) | P5326 (floral meristem-expressed AP1 prom.) | P4205 | 4271 | Inc. lycopene |
| G1772 | 342 | RING/C3HC4 (123-176) | P5310 (root-expressed RSI1 prom.) | P8224 | 4664 | Inc. fruit weight |
| G1774 | 344 | RING/C3HC4 (128-242) | P6506 (constitutive CaMv 35S prom.) | P6861 | 4484 | Inc. brix |
| G1775 | 346 | RING/C3HC4 (121-241) | P5318 (shoot apical meristem-expressed STM prom.) | P7869 | 4633 | Inc. brix |
| G1777 | 348 | RING/C3HC4 (124-247) | P5297 (fruit tissue-expressed PG prom.) | P6895 | 4495 | Inc. brix |
| G1781 | 350 | CAAT (35-124) | P5318 (shoot apical meristem-expressed STM prom.) | P4774 | 4355 | Inc. brix |
| G1781 | 350 | CAAT (35-124) | P5284 (leaf-expressed RbcS3 prom.) | P4774 | 4355 | Inc. fruit weight |
| G1786 | 352 | MYB-(R1)R2R3 (NA) | P5326 (floral meristem-expressed AP1 prom.) | P4037 | 4251 | Inc. fruit weight |
| G1786 | 352 | MYB-(R1)R2R3 (NA) | P5318 (shoot apical meristem-expressed STM prom.) | P4037 | 4251 | Inc. fruit weight |
| G1789 | 354 | MYB-related (12-62) | P5287 (epidermal tissue-expressed LTP1 prom.) | P4358 | 4287 | Inc. lycopene |
| G1797 | 358 | MADS (1-57) | P5284 (leaf-expressed RbcS3 prom.) | P8673 | 4738 | Inc. brix |
| G1797 | 358 | MADS (1-57) | P5284 (leaf-expressed RbcS3 prom.) | P8673 | 4738 | Inc. lycopene |
| G1800 | 360 | AP2 (25-92) | P5287 (epidermal tissue-expressed LTP1 prom.) | P4209 | 4273 | Inc. brix |
| G1800 | 360 | AP2 (25-92) | P5318 (shoot apical meristem-expressed STM prom.) | P4209 | 4273 | Inc. brix |
| G1800 | 360 | AP2 (25-92) | P5297 (fruit tissue-expressed PG prom.) | P4209 | 4273 | Inc. brix |
| G1804 | 362 | bZIP (357-407) | P5287 (epidermal tissue-expressed LTP1 prom.) | P6416 | 4444 | Inc. brix |
| G1806 | 364 | bZIP (165-225) | P5287 (epidermal tissue-expressed LTP1 prom.) | P6061 | 4422 | Inc. brix |
| G1807 | 366 | bZIP (249-297) | P6506 (constitutive CaMv 35S prom.) | P6415 | 4443 | Inc. brix |
| G1808 | 368 | bZIP (140-200) | P5318 (shoot apical meristem-expressed STM prom.) | P4601 | 4324 | Inc. brix |
| G1808 | 368 | bZIP (140-200) | P6506 (constitutive CaMv 35S prom.) | P4601 | 4324 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1809 | 370 | bZIP (23-35, 68-147) | P5287 (epidermal tissue-expressed LTP1 prom.) | P3982 | 4238 | Inc. lycopene |
| G1811 | 372 | ABI3/VP-1 (34-128) | P5284 (leaf-expressed RbcS3 prom.) | P5884 | 4409 | Inc. lycopene |
| G1812 | 374 | PCOMB (32-365) | P5297 (fruit tissue-expressed PG prom.) | P7789 | 4618 | Inc. fruit weight |
| G1812 | 374 | PCOMB (32-365) | P5303 (fruit tissue-expressed PD prom.) | P7789 | 4618 | Inc. fruit weight |
| G1812 | 374 | PCOMB (32-365) | P5326 (floral meristem-expressed AP1 prom.) | P7789 | 4618 | Inc. fruit weight |
| G1812 | 374 | PCOMB (32-365) | P5319 (emergent leaf primordia-expressed AS1 prom.) | P7789 | 4618 | Inc. fruit weight |
| G1819 | 376 | CAAT (52-148) | P5326 (floral meristem-expressed AP1 prom.) | P4039 | 4252 | Inc. brix |
| G1821 | 378 | CAAT (57-146) | P5297 (fruit tissue-expressed PG prom.) | P4040 | 4253 | Inc. lycopene |
| G1824 | 380 | GARP (158-205) | P5287 (epidermal tissue-expressed LTP1 prom.) | P7446 | 4546 | Inc. brix |
| G1824 | 380 | GARP (158-205) | P5297 (fruit tissue-expressed PG prom.) | P7446 | 4546 | Dark green fruit |
| G1836 | 382 | CAAT (24-110) | P5318 (shoot apical meristem-expressed STM prom.) | P3603 | 4198 | Inc. lycopene |
| G1836 | 382 | CAAT (24-110) | P5326 (floral meristem-expressed AP1 prom.) | P3603 | 4198 | Inc. lycopene |
| G1838 | 384 | AP2 (230-304, 330-400) | P5284 (leaf-expressed RbcS3 prom.) | P6474 | 4467 | Inc. brix |
| G1839 | 386 | AP2 (118-182) | P5297 (fruit tissue-expressed PG prom.) | P4166 | 4260 | Inc. lycopene |
| G1839 | 386 | AP2 (118-182) | P6506 (constitutive CaMv 35S prom.) | P4166 | 4260 | Inc. lycopene |
| G1842 | 388 | MADS (2-57) | P5287 (epidermal tissue-expressed LTP1 prom.) | P7845 | 4623 | Inc. brix |
| G1842 | 388 | MADS (2-57) | P5287 (epidermal tissue-expressed LTP1 prom.) | P7845 | 4623 | Inc. lycopene |
| G1843 | 390 | MADS (2-57) | P6506 (constitutive CaMv 35S prom.) | P4402 | 4300 | Inc. lycopene |
| G1844 | 392 | MADS (2-57) | P5318 (shoot apical meristem-expressed STM prom.) | P4403 | 4301 | Inc. brix |
| G1847 | 394 | WRKY (141-200) | P5326 (floral meristem-expressed AP1 prom.) | P8237 | 4673 | Inc. fruit weight |
| G1847 | 394 | WRKY (141-200) | P5284 (leaf-expressed RbcS3 prom.) | P8237 | 4673 | Inc. fruit weight |
| G1847 | 394 | WRKY (141-200) | P5318 (shoot apical meristem-expressed STM prom.) | P8237 | 4673 | Inc. fruit weight |
| G1850 | 396 | HS (59-150) | P5297 (fruit tissue-expressed PG prom.) | P7867 | 4632 | Inc. lycopene |
| G1850 | 396 | HS (59-150) | P5326 (floral meristem-expressed AP1 prom.) | P7867 | 4632 | Inc. fruit weight |
| G1855 | 398 | AKR (102-613) | P5284 (leaf-expressed RbcS3 prom.) | P5886 | 4411 | Inc. fruit weight |
| G1855 | 398 | AKR (102-613) | P5318 (shoot apical meristem-expressed STM prom.) | P5886 | 4411 | Inc. fruit weight |
| G1855 | 398 | AKR (102-613) | P5326 (floral meristem-expressed AP1 prom.) | P5886 | 4411 | Inc. fruit weight |
| G1863 | 400 | GRF-like (76-187) | P5297 (fruit tissue-expressed PG prom.) | P4179 | 4262 | Inc. lycopene |
| G1865 | 402 | GRF-like (45-162) | P5326 (floral meristem-expressed AP1 prom.) | P3645 | 4207 | Inc. lycopene |
| G1881 | 404 | Z-CO-like (5-28, 56-79) | P5284 (leaf-expressed RbcS3 prom.) | P6466 | 4463 | Inc. brix |
| G1881 | 404 | Z-CO-like (5-28, 56-79) | P6506 (constitutive CaMv 35S prom.) | P6466 | 4463 | Inc. lycopene |
| G1884 | 406 | Z-Dof (43-71) | P5287 (epidermal tissue-expressed LTP1 prom.) | P4563 | 4314 | Inc. lycopene |
| G1888 | 408 | Z-CO-like (2-33, 58-100) | P5297 (fruit tissue-expressed PG prom.) | P4219 | 4275 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1888 | 408 | Z-CO-like (2-33, 58-100) | P5326 (floral meristem-expressed AP1 prom.) | P4219 | 4275 | Inc. fruit weight |
| G1896 | 412 | Z-Dof (43-85) | P5326 (floral meristem-expressed AP1 prom.) | P4706 | 4331 | Inc. brix |
| G1896 | 412 | Z-Dof (43-85) | P5287 (epidermal tissue-expressed LTP1 prom.) | P4706 | 4331 | Inc. brix |
| G1896 | 412 | Z-Dof (43-85) | P5303 (fruit tissue-expressed PD prom.) | P4706 | 4331 | Inc. brix |
| G1896 | 412 | Z-Dof (43-85) | P5287 (epidermal tissue-expressed LTP1 prom.) | P4706 | 4331 | Inc. lycopene |
| G1896 | 412 | Z-Dof (43-85) | P5303 (fruit tissue-expressed PD prom.) | P4706 | 4331 | Inc. biomass |
| G1898 | 414 | Z-Dof (31-59) | P5297 (fruit tissue-expressed PG prom.) | P4226 | 4277 | Inc. brix |
| G1901 | 420 | Z-Dof (NA) | P5319 (emergent leaf primordia-expressed AS1 prom.) | P3972 | 4233 | Inc. lycopene |
| G1903 | 422 | Z-Dof (134-180) | P5287 (epidermal tissue-expressed LTP1 prom.) | P3617 | 4202 | Inc. lycopene |
| G1906 | 424 | Z-Dof (19-47) | P5284 (leaf-expressed RbcS3 prom.) | P3975 | 4234 | Inc. lycopene |
| G1917 | 426 | GATA/Zn (153-179) | P5318 (shoot apical meristem-expressed STM prom.) | P4952 | 4368 | Inc. lycopene |
| G1918 | 428 | RING/C3HC4 (26-164) | P5326 (floral meristem-expressed AP1 prom.) | P4367 | 4291 | Inc. fruit weight |
| G1923 | 430 | NAC (23-153) | P5326 (floral meristem-expressed AP1 prom.) | P9167 | 4803 | Inc. fruit weight |
| G1925 | 432 | NAC (6-150) | P5326 (floral meristem-expressed AP1 prom.) | P6209 | 4438 | Inc. brix |
| G1933 | 434 | WRKY (205-263, 344-404) | P5318 (shoot apical meristem-expressed STM prom.) | P7874 | 4637 | Inc. brix |
| G1933 | 434 | WRKY (205-263, 344-404) | P5297 (fruit tissue-expressed PG prom.) | P7874 | 4637 | Inc. brix |
| G1933 | 434 | WRKY (205-263, 344-404) | P5297 (fruit tissue-expressed PG prom.) | P7874 | 4637 | Inc. lycopene |
| G1936 | 436 | PCF (64-129) | P5297 (fruit tissue-expressed PG prom.) | P4214 | 4274 | Inc. brix |
| G1936 | 436 | PCF (64-129) | P5284 (leaf-expressed RbcS3 prom.) | P4214 | 4274 | Inc. lycopene |
| G1944 | 440 | AT-hook (89-97, 170-285) | P5326 (floral meristem-expressed AP1 prom.) | P4146 | 4255 | Inc. brix |
| G1947 | 442 | HS (19-110) | P5324 (fruit vascular tissue-expressed Cru prom.) | P4553 | 4311 | Inc. biomass* |
| G1950 | 444 | AKR (65-228) | P5318 (shoot apical meristem-expressed STM prom.) | P3651 | 4210 | Inc. lycopene |
| G1950 | 444 | AKR (65-228) | P5287 (epidermal tissue-expressed LTP1 prom.) | P3651 | 4210 | Inc. lycopene |
| G1950 | 444 | AKR (65-228) | P5303 (fruit tissue-expressed PD prom.) | P3651 | 4210 | Inc. lycopene |
| G1957 | 446 | ABI3/VP-1 (52-143) | P5318 (shoot apical meristem-expressed STM prom.) | P7451 | 4547 | Inc. brix |
| G1957 | 446 | ABI3/VP-1 (52-143) | P5297 (fruit tissue-expressed PG prom.) | P7451 | 4547 | Inc. brix |
| G1957 | 446 | ABI3/VP-1 (52-143) | P5319 (emergent leaf primordia-expressed AS1 prom.) | P7451 | 4547 | Inc. brix |
| G1957 | 446 | ABI3/VP-1 (52-143) | P5326 (floral meristem-expressed AP1 prom.) | P7451 | 4547 | Inc. brix |
| G1957 | 446 | ABI3/VP-1 (52-143) | P5303 (fruit tissue-expressed PD prom.) | P7451 | 4547 | Inc. brix |
| G1957 | 446 | ABI3/VP-1 (52-143) | P5324 (fruit vascular tissue-expressed Cru prom.) | P7451 | 4547 | Inc. brix |
| G1957 | 446 | ABI3/VP-1 (52-143) | P5303 (fruit tissue-expressed PD prom.) | P7451 | 4547 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G1957 | 446 | ABI3/VP-1 (52-143) | P5319 (emergent leaf primordia-expressed AS1 prom.) | P7451 | 4547 | Inc. lycopene |
| G1957 | 446 | ABI3/VP-1 (52-143) | P5324 (fruit vascular tissue-expressed Cru prom.) | P7451 | 4547 | Inc. lycopene |
| G1957 | 446 | ABI3/VP-1 (52-143) | P5326 (floral meristem-expressed AP1 prom.) | P7451 | 4547 | Inc. lycopene |
| G1957 | 446 | ABI3/VP-1 (52-143) | P5318 (shoot apical meristem-expressed STM prom.) | P7451 | 4547 | Inc. lycopene |
| G1957 | 446 | ABI3/VP-1 (52-143) | P5297 (fruit tissue-expressed PG prom.) | P7451 | 4547 | Inc. lycopene |
| G1957 | 446 | ABI3/VP-1 (52-143) | P5284 (leaf-expressed RbcS3 prom.) | P7451 | 4547 | Inc. lycopene |
| G1959 | 448 | GARP (46-97) | P5284 (leaf-expressed RbcS3 prom.) | P4584 | 4318 | Inc. fruit weight |
| G1965 | 450 | Z-Dof (27-55) | P5287 (epidermal tissue-expressed LTP1 prom.) | P3960 | 4228 | Inc. brix |
| G1965 | 450 | Z-Dof (27-55) | P5297 (fruit tissue-expressed PG prom.) | P3960 | 4228 | Inc. brix |
| G1965 | 450 | Z-Dof (27-55) | P5326 (floral meristem-expressed AP1 prom.) | P3960 | 4228 | Inc. brix |
| G1969 | 452 | Z-C2H2 (93-113, 129-152, 230-252) | P5284 (leaf-expressed RbcS3 prom.) | P7762 | 4607 | Inc. lycopene |
| G1969 | 452 | Z-C2H2 (93-113, 129-152, 230-252) | P5297 (fruit tissue-expressed PG prom.) | P7762 | 4607 | Inc. lycopene |
| G1969 | 452 | Z-C2H2 (93-113, 129-152, 230-252) | P5310 (root-expressed RSI1 prom.) | P7762 | 4607 | Inc. lycopene |
| G1969 | 452 | Z-C2H2 (93-113, 129-152, 230-252) | P5326 (floral meristem-expressed AP1 prom.) | P7762 | 4607 | Inc. fruit weight |
| G1969 | 452 | Z-C2H2 (93-113, 129-152, 230-252) | P5318 (shoot apical meristem-expressed STM prom.) | P7762 | 4607 | Inc. fruit weight |
| G1972 | 454 | Z-C2H2 (79-101, 132-152, 342-364, 411-433) | P5284 (leaf-expressed RbcS3 prom.) | P8504 | 4690 | Inc. brix |
| G1972 | 454 | Z-C2H2 (79-101, 132-152, 342-364, 411-433) | P5310 (root-expressed RSI1 prom.) | P8504 | 4690 | Inc. brix |
| G1972 | 454 | Z-C2H2 (79-101, 132-152, 342-364, 411-433) | P5310 (root-expressed RSI1 prom.) | P8504 | 4690 | Inc. lycopene |
| G1981 | 456 | Z-C3H (45-157) | P5318 (shoot apical meristem-expressed STM prom.) | P8492 | 4687 | Inc. fruit weight |
| G1981 | 456 | Z-C3H (45-157) | P5284 (leaf-expressed RbcS3 prom.) | P8492 | 4687 | Inc. fruit weight |
| G1987 | 458 | Z-C2H2 (103-123) | P5284 (leaf-expressed RbcS3 prom.) | | | Inc. lycopene |
| G1987 | 458 | Z-C2H2 (103-123) | P5318 (shoot apical meristem-expressed STM prom.) | | | Inc. fruit weight |
| G1990 | 460 | Z-C2H2 (184-204, 261-283) | P5310 (root-expressed RSI1 prom.) | P8692 | 4746 | Inc. lycopene |
| G1990 | 460 | Z-C2H2 (184-204, 261-283) | P5287 (epidermal tissue-expressed LTP1 prom.) | P8692 | 4746 | Inc. lycopene |
| G1990 | 460 | Z-C2H2 (184-204, 261-283) | P5297 (fruit tissue-expressed PG prom.) | P8692 | 4746 | Inc. lycopene |
| G1991 | 462 | Z-C2H2 (6-26, 175-195, 224-226) | P5284 (leaf-expressed RbcS3 prom.) | P8151 | 4649 | Inc. brix |
| G2005 | 468 | Z-Dof (29-71) | P5326 (floral meristem-expressed AP1 prom.) | P7557 | 4580 | Inc. brix |
| G2005 | 468 | Z-Dof (29-71) | P5318 (shoot apical meristem-expressed STM prom.) | P7557 | 4580 | Inc. brix |
| G2006 | 470 | MYB-(R1)R2R3 (NA) | P5284 (leaf-expressed RbcS3 prom.) | P6455 | 4460 | Inc. brix |
| G2007 | 472 | MYB-(R1)R2R3 (14-118) | P5310 (root-expressed RSI1 prom.) | P4400 | 4299 | Inc. lycopene |
| G2011 | 474 | HS (55-146) | P5326 (floral meristem-expressed AP1 prom.) | P6903 | 4498 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2011 | 474 | HS (55-146) | P5318 (shoot apical meristem-expressed STM prom.) | P6903 | 4498 | Inc. fruit weight |
| G2011 | 474 | HS (55-146) | P5319 (emergent leaf primordia-expressed AS1 prom.) | P6903 | 4498 | Inc. fruit weight |
| G2015 | 476 | AKR (131-454) | P5284 (leaf-expressed RbcS3 prom.) | P7465 | 4554 | Inc. brix |
| G2015 | 476 | AKR (131-454) | P5287 (epidermal tissue-expressed LTP1 prom.) | P7465 | 4554 | Inc. brix |
| G2018 | 478 | AKR (101-416) | P5287 (epidermal tissue-expressed LTP1 prom.) | P7582 | 4587 | Inc. lycopene |
| G2020 | 480 | AKR (122-486) | P5324 (fruit vascular tissue-expressed Cru prom.) | P7458 | 4550 | Inc. brix |
| G2020 | 480 | AKR (122-486) | P6506 (constitutive CaMv 35S prom.) | P7458 | 4550 | Inc. brix |
| G2020 | 480 | AKR (122-486) | P5287 (epidermal tissue-expressed LTP1 prom.) | P7458 | 4550 | Inc. brix |
| G2020 | 480 | AKR (122-486) | P5303 (fruit tissue-expressed PD prom.) | P7458 | 4550 | Inc. brix |
| G2020 | 480 | AKR (122-486) | P5297 (fruit tissue-expressed PG prom.) | P7458 | 4550 | Inc. lycopene |
| G2020 | 480 | AKR (122-486) | P5303 (fruit tissue-expressed PD prom.) | P7458 | 4550 | Inc. lycopene |
| G2020 | 480 | AKR (122-486) | P5303 (fruit tissue-expressed PD prom.) | P7458 | 4550 | Inc. fruit weight |
| G2053 | 484 | NAC (6-152) | P5297 (fruit tissue-expressed PG prom.) | P4738 | 4339 | Inc. brix |
| G2053 | 484 | NAC (6-152) | P5297 (fruit tissue-expressed PG prom.) | P4738 | 4339 | Inc. lycopene |
| G2057 | 486 | TEO (46-103) | P5297 (fruit tissue-expressed PG prom.) | P3983 | 4239 | Inc. fruit weight |
| G2059 | 488 | AP2 (184-251) | P5326 (floral meristem-expressed AP1 prom.) | P6463 | 4462 | Inc. brix |
| G2059 | 488 | AP2 (184-251) | P5297 (fruit tissue-expressed PG prom.) | P6463 | 4462 | Inc. brix |
| G2061 | 492 | MADS (1-57) | P5310 (root-expressed RSI1 prom.) | P7756 | 4605 | Inc. lycopene |
| G2062 | 494 | MADS (8-63) | P5287 (epidermal tissue-expressed LTP1 prom.) | P4392 | 4296 | Inc. fruit weight |
| G2063 | 496 | MADS (7-63) | P5284 (leaf-expressed RbcS3 prom.) | P7464 | 4553 | Inc. fruit weight |
| G2068 | 498 | bZIP (338-455) | P5310 (root-expressed RSI1 prom.) | P8586 | 4708 | Inc. lycopene |
| G2071 | 500 | bZIP (307-358) | P5310 (root-expressed RSI1 prom.) | | | Inc. lycopene |
| G2072 | 502 | bZIP (90-149) | P5319 (emergent leaf primordia-expressed AS1 prom.) | P4603 | 4325 | Inc. lycopene |
| G2084 | 504 | RING/C3HC4 (41-172) | P5319 (emergent leaf primordia-expressed AS1 prom.) | P6896 | 4496 | Inc. fruit weight |
| G2084 | 504 | RING/C3HC4 (41-172) | P5319 (emergent leaf primordia-expressed AS1 prom.) | P6896 | 4496 | Inc. biomass |
| G2085 | 506 | GATA/Zn (214-241) | P5326 (floral meristem-expressed AP1 prom.) | | | Inc. fruit weight |
| G2085 | 506 | GATA/Zn (214-241) | P5287 (epidermal tissue-expressed LTP1 prom.) | | | Inc. fruit weight |
| G2086 | 508 | RING/C3HC4 (83-131) | P5284 (leaf-expressed RbcS3 prom.) | P4348 | 4284 | Inc. lycopene |
| G2092 | 512 | RING/C3HC4 (176-208) | P5318 (shoot apical meristem-expressed STM prom.) | P8226 | 4666 | Inc. fruit weight |
| G2094 | 514 | GATA/Zn (43-68) | P5284 (leaf-expressed RbcS3 prom.) | P7074 | 4512 | Inc. fruit weight |
| G2105 | 520 | TH (100-153) | P5297 (fruit tissue-expressed PG prom.) | P6877 | 4490 | Inc. brix |
| G2107 | 522 | AP2 (27-94) | P5287 (epidermal tissue-expressed LIP1 prom.) | P7170 | 4543 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2108 | 524 | AP2 (18-85) | P5297 (fruit tissue-expressed PG prom.) | P4196 | 4268 | Inc. lycopene |
| G2108 | 524 | AP2 (18-85) | P5324 (fruit vascular tissue-expressed Cru prom.) | P4196 | 4268 | Inc. lycopene |
| G2109 | 526 | MADS (1-57) | P5284 (leaf-expressed RbcS3 prom.) | P7509 | 4566 | Inc. brix |
| G2109 | 526 | MADS (1-57) | P5326 (floral meristem-expressed AP1 prom.) | P7509 | 4566 | Inc. fruit weight |
| G2116 | 530 | bZIP (150-210) | P6506 (constitutive CaMv 35S prom.) | P4605 | 4326 | Inc. lycopene |
| G2116 | 530 | bZIP (150-210) | P5297 (fruit tissue-expressed PG prom.) | P4605 | 4326 | Inc. lycopene |
| G2117 | 532 | bZIP (46-106) | P5326 (floral meristem-expressed AP1 prom.) | P4606 | 4327 | Inc. brix |
| G2117 | 532 | bZIP (46-106) | P5326 (floral meristem-expressed AP1 prom.) | P4606 | 4327 | Inc. brix |
| G2117 | 532 | bZIP (46-106) | P5284 (leaf-expressed RbcS3 prom.) | P4606 | 4327 | Inc. fruit weight |
| G2121 | 534 | VAR (130-226) | P5303 (fruit tissue-expressed PD prom.) | P6199 | 4435 | Inc. brix |
| G2121 | 534 | VAR (130-226) | P5318 (shoot apical meristem-expressed STM prom.) | P6199 | 4435 | Inc. brix |
| G2129 | 536 | bZIP (71-140) | P5303 (fruit tissue-expressed PD prom.) | P7539 | 4577 | Inc. brix |
| G2130 | 538 | AP2 (101-169) | P5326 (floral meristem-expressed AP1 prom.) | P6056 | 4421 | Inc. fruit weight |
| G2130 | 538 | AP2 (101-169) | P5287 (epidermal tissue-expressed LTP1 prom.) | P6056 | 4421 | Inc. fruit weight |
| G2130 | 538 | AP2 (101-169) | P5297 (fruit tissue-expressed PG prom.) | P6056 | 4421 | Inc. fruit weight |
| G2130 | 538 | AP2 (101-169) | P5318 (shoot apical meristem-expressed STM prom.) | P6056 | 4421 | Inc. fruit weight |
| G2132 | 540 | AP2 (84-151) | P5297 (fruit tissue-expressed PG prom.) | P4229 | 4278 | Inc. lycopene |
| G2135 | 542 | AP2 (73-140) | P5287 (epidermal tissue-expressed LTP1 prom.) | P4363 | 4289 | Inc. brix |
| G2135 | 542 | AP2 (73-140) | P5287 (epidermal tissue-expressed LTP1 prom.) | P4363 | 4289 | Inc. fruit weight |
| G2139 | 544 | MADS (14-69) | P5287 (epidermal tissue-expressed LTP1 prom.) | P6884 | 4491 | Inc. lycopene |
| G2139 | 544 | MADS (14-69) | P5318 (shoot apical meristem-expressed STM prom.) | P6884 | 4491 | Inc. fruit weight |
| G2141 | 546 | HLH/MYC (306-364) | P5297 (fruit tissue-expressed PG prom.) | P4753 | 4344 | Inc. brix |
| G2141 | 546 | HLH/MYC (306-364) | P5297 (fruit tissue-expressed PG prom.) | P4753 | 4344 | Inc. lycopene |
| G2144 | 548 | HLH/MYC (207-265) | P5284 (leaf-expressed RbcS3 prom.) | P4597 | 4322 | Inc. brix |
| G2145 | 550 | HLH/MYC (170-227) | P5284 (leaf-expressed RbcS3 prom.) | P4754 | 4345 | Inc. lycopene |
| G2147 | 552 | HLH/MYC (163-220) | P5287 (epidermal tissue-expressed LTP1 prom.) | P4574 | 4315 | Inc. brix |
| G2147 | 552 | HLH/MYC (163-220) | P5287 (epidermal tissue-expressed LTP1 prom.) | P4574 | 4315 | Inc. lycopene |
| G2148 | 554 | HLH/MYC (135-192) | P5318 (shoot apical meristem-expressed STM prom.) | P7877 | 4638 | Inc. brix |
| G2148 | 554 | HLH/MYC (135-192) | P5318 (shoot apical meristem-expressed STM prom.) | P7877 | 4638 | Inc. lycopene |
| G2150 | 556 | HLH/MYC (194-252) | P6506 (constitutive CaMv 35S prom.) | P4598 | 4323 | Inc. lycopene |
| G2154 | 558 | AT-hook (105-113, 171-283) | P5324 (fruit vascular tissue-expressed Cru prom.) | P6196 | 4433 | Inc. brix |
| G2156 | 560 | AT-hook (72-80, 81-232) | P5297 (fruit tissue-expressed PG prom.) | P4418 | 4304 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2156 | 560 | AT-hook (72-80, 81-232) | P5319 (emergent leaf primordia-expressed AS1 prom.) | P4418 | 4304 | Inc. fruit weight |
| G2156 | 560 | AT-hook (72-80, 81-232) | P5303 (fruit tissue-expressed PD prom.) | P4418 | 4304 | Inc. fruit weight |
| G2157 | 562 | AT-hook (88-96, 97-240) | P5287 (epidermal tissue-expressed LTP1 prom.) | P4419 | 4305 | Inc. lycopene |
| G2213 | 572 | bZIP-NIN (156-205) | P5297 (fruit tissue-expressed PG prom.) | P7541 | 4578 | Inc. brix |
| G2215 | 574 | bZIP-NIN (150-246) | P5284 (leaf-expressed RbcS3 prom.) | P4608 | 4328 | Inc. brix |
| G2223 | 578 | RING/C3H2C3 (338-378) | P5318 (shoot apical meristem-expressed STM prom.) | P8256 | 4684 | Inc. fruit weight |
| G2226 | 580 | RING/C3H2C3 (103-144) | P5297 (fruit tissue-expressed PG prom.) | P8236 | 4672 | Inc. lycopene |
| G2237 | 582 | RING/C3H2C3 (127-168) | P5284 (leaf-expressed RbcS3 prom.) | P8247 | 4678 | Inc. lycopene |
| G2238 | 584 | RING/C3H2C3 (113-154) | P5284 (leaf-expressed RbcS3 prom.) | P8248 | 4679 | Inc. brix |
| G2238 | 584 | RING/C3H2C3 (113-154) | P5284 (leaf-expressed RbcS3 prom.) | P8248 | 4679 | Inc. lycopene |
| G2238 | 584 | RING/C3H2C3 (113-154) | P5310 (root-expressed RSI1 prom.) | P8248 | 4679 | Inc. lycopene |
| G2239 | 586 | RING/C3H2C3 (128-169) | P5287 (epidermal tissue-expressed LTP1 prom.) | P8588 | 4710 | Inc. fruit weight |
| G2251 | 590 | RING/C3H2C3 (89-132) | P5297 (fruit tissue-expressed PG prom.) | P8249 | 4680 | Inc. fruit weight |
| G2251 | 590 | RING/C3H2C3 (89-132) | P5326 (floral meristem-expressed AP1 prom.) | P8249 | 4680 | Inc. fruit weight |
| G2251 | 590 | RING/C3H2C3 (89-132) | P5318 (shoot apical meristem-expressed STM prom.) | P8249 | 4680 | Inc. fruit weight |
| G2251 | 590 | RING/C3H2C3 (89-132) | P5287 (epidermal tissue-expressed LTP1 prom.) | P8249 | 4680 | Inc. fruit weight |
| G2251 | 590 | RING/C3H2C3 (89-132) | P5284 (leaf-expressed RbcS3 prom.) | P8249 | 4680 | Inc. fruit weight |
| G2252 | 592 | RING/C3H2C3 (257-297) | P5310 (root-expressed RSI1 prom.) | P8250 | 4681 | Inc. fruit weight |
| G2269 | 594 | RING/C3H2C3 (136-177) | P5310 (root-expressed RSI1 prom.) | P8252 | 4682 | Inc. lycopene |
| G2269 | 594 | RING/C3H2C3 (136-177) | P5287 (epidermal tissue-expressed LTP1 prom.) | P8252 | 4682 | Inc. fruit weight |
| G2269 | 594 | RING/C3H2C3 (136-177) | P5297 (fruit tissue-expressed PG prom.) | P8252 | 4682 | Inc. fruit weight |
| G2269 | 594 | RING/C3H2C3 (136-177) | P5326 (floral meristem-expressed AP1 prom.) | P8252 | 4682 | Inc. fruit weight |
| G2269 | 594 | RING/C3H2C3 (136-177) | P5318 (shoot apical meristem-expressed STM prom.) | P8252 | 4682 | Inc. fruit weight |
| G2290 | 600 | WRKY (147-205) | P5297 (fruit tissue-expressed PG prom.) | P4742 | 4341 | Inc. brix |
| G2290 | 600 | WRKY (147-205) | P6506 (constitutive CaMv 35S prom.) | P4742 | 4341 | Chlorotic |
| G2291 | 602 | AP2 (113-180) | P5287 (epidermal tissue-expressed LTP1 prom.) | P7125 | 4529 | Inc. brix |
| G2291 | 602 | AP2 (113-180) | P5324 (fruit vascular tissue-expressed Cru prom.) | P7125 | 4529 | Inc. brix |
| G2291 | 602 | AP2 (113-180) | P5318 (shoot apical meristem-expressed STM prom.) | P7125 | 4529 | Inc. fruit weight |
| G2293 | 604 | WRKY (74-134) | P5324 (fruit vascular tissue-expressed Cru prom.) | P6213 | 4440 | Inc. fruit weight |
| G2295 | 606 | MADS (1-57) | P5284 (leaf-expressed RbcS3 prom.) | P7859 | 4626 | Inc. brix |
| G2296 | 608 | WRKY (85-145) | P5319 (emergent leaf primordia-expressed AS1 prom.) | P4741 | 4340 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
| --- | --- | --- | --- | --- | --- | --- |
| G2296 | 608 | WRKY (85-145) | P5324 (fruit vascular tissue-expressed Cru prom.) | P4741 | 4340 | Inc. brix |
| G2296 | 608 | WRKY (85-145) | P5284 (leaf-expressed RbcS3 prom.) | P4741 | 4340 | Inc. lycopene |
| G2299 | 610 | AP2 (48-115) | P5318 (shoot apical meristem-expressed STM prom.) | P6211 | 4439 | Inc. brix |
| G2304 | 612 | AKR (381-886) | P5287 (epidermal tissue-expressed LTP1 prom.) | P8209 | 4659 | Inc. fruit weight |
| G2313 | 614 | MYB-related (111-159) | P5297 (fruit tissue-expressed PG prom.) | P4382 | 4294 | Inc. brix |
| G2313 | 614 | MYB-related (111-159) | P5319 (emergent leaf primordia-expressed AS1 prom.) | P4382 | 4294 | Inc. lycopene |
| G2313 | 614 | MYB-related (111-159) | P5297 (fruit tissue-expressed PG prom.) | P4382 | 4294 | Inc. fruit weight |
| G2315 | 616 | PMR (4-60) | P5326 (floral meristem-expressed AP1 prom.) | P7723 | 4596 | Inc. lycopene |
| G2316 | 618 | PMR (96-282) | P5287 (epidermal tissue-expressed LTP1 prom.) | P7078 | 4513 | Inc. lycopene |
| G2318 | 620 | MYB-related (134-182) | P5318 (shoot apical meristem-expressed STM prom.) | P5885 | 4410 | Inc. brix |
| G2318 | 620 | MYB-related (134-182) | P5310 (root-expressed RSI1 prom.) | P5885 | 4410 | Inc. lycopene |
| G2334 | 624 | GRF-like (82-194) | P5310 (root-expressed RSI1 prom.) | P8694 | 4747 | Inc. lycopene |
| G2342 | 626 | MYB-(R1)R2R3 (75-179) | P5326 (floral meristem-expressed AP1 prom.) | P7872 | 4636 | Inc. fruit weight |
| G2343 | 628 | MYB-(R1)R2R3 (14-116) | P5297 (fruit tissue-expressed PG prom.) | P9162 | 4801 | Inc. fruit weight |
| G2344 | 630 | CAAT (100-159) | P5287 (epidermal tissue-expressed LTP1 prom.) | P6063 | 4424 | Inc. fruit weight |
| G2371 | 636 | ABI3/VP-1 (25-127) | P5326 (floral meristem-expressed AP1 prom.) | P8070 | 4639 | Inc. brix |
| G2371 | 636 | ABI3/VP-1 (25-127) | P5287 (epidermal tissue-expressed LTP1 prom.) | P8070 | 4639 | Inc. lycopene |
| G2373 | 638 | TH (290-350) | P5326 (floral meristem-expressed AP1 prom.) | P4609 | 4329 | Inc. lycopene |
| G2376 | 640 | TH (79-178, 336-408) | P5287 (epidermal tissue-expressed LTP1 prom.) | P4610 | 4330 | Inc. brix |
| G2376 | 640 | TH (79-178, 336-408) | P5287 (epidermal tissue-expressed LTP1 prom.) | P4610 | 4330 | Inc. lycopene |
| G2376 | 640 | TH (79-178, 336-408) | P5297 (fruit tissue-expressed PG prom.) | P4610 | 4330 | Inc. lycopene |
| G2376 | 640 | TH (79-178, 336-408) | P5318 (shoot apical meristem-expressed STM prom.) | P4610 | 4330 | Inc. lycopene |
| G2376 | 640 | TH (79-178, 336-408) | P5319 (emergent leaf primordia-expressed AS1 prom.) | P4610 | 4330 | Inc. lycopene |
| G2377 | 642 | TH (17-110, 153-237) | P5318 (shoot apical meristem-expressed STM prom.) | P7485 | 4560 | Inc. fruit weight |
| G2394 | 646 | RING/C3H2C3 (355-395) | P5310 (root-expressed RSI1 prom.) | P9030 | 4767 | Inc. lycopene |
| G2400 | 648 | RING/C3H2C3 (158-198) | P5287 (epidermal tissue-expressed LTP1 prom.) | P8255 | 4683 | Inc. fruit weight |
| G2417 | 652 | GARP (235-285) | P5287 (epidermal tissue-expressed LTP1 prom.) | P4394 | 4297 | Inc. lycopene |
| G2421 | 656 | MYB-(R1)R2R3 (9-110) | P5318 (shoot apical meristem-expressed STM prom.) | P7844 | 4622 | Inc. brix |
| G2421 | 656 | MYB-(R1)R2R3 (9-110) | P5318 (shoot apical meristem-expressed STM prom.) | P7844 | 4622 | Inc. lycopene |
| G2422 | 658 | MYB-(R1)R2R3 (9-110) | P5310 (root-expressed RSI1 prom.) | P9164 | 4802 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2422 | 658 | MYB-(R1)R2R3 (9-110) | P5318 (shoot apical meristem-expressed STM prom.) | P9164 | 4802 | Inc. fruit weight |
| G2425 | 660 | MYB-(R1)R2R3 (12-119) | P5284 (leaf-expressed RbcS3 prom.) | P4396 | 4298 | Inc. brix |
| G2426 | 662 | MYB-(R1)R2R3 (14-114) | P5297 (fruit tissue-expressed PG prom.) | P6478 | 4468 | Inc. brix |
| G2427 | 664 | MYB-(R1)R2R3 (90-244) | P5284 (leaf-expressed RbcS3 prom.) | P4724 | 4336 | Inc. brix |
| G2437 | 668 | GATA/Zn (223-250) | P5310 (root-expressed RSI1 prom.) | P9274 | 4823 | Inc. lycopene |
| G2437 | 668 | GATA/Zn (223-250) | P5326 (floral meristem-expressed AP1 prom.) | P9274 | 4823 | Inc. fruit weight |
| G2452 | 672 | MYB-related (28-79, 146-194) | P5297 (fruit tissue-expressed PG prom.) | P6206 | 4436 | Inc. brix |
| G2454 | 674 | YABBY (25-64, 136-183) | P5326 (floral meristem-expressed AP1 prom.) | P8594 | 4711 | Inc. fruit weight |
| G2457 | 676 | YABBY (21-59, 110-157) | P5318 (shoot apical meristem-expressed STM prom.) | P8560 | 4700 | Inc. fruit weight |
| G2457 | 676 | YABBY (21-59, 110-157) | P5284 (leaf-expressed RbcS3 prom.) | P8560 | 4700 | Inc. fruit weight |
| G2462 | 680 | E2F (126-350) | P5287 (epidermal tissue-expressed LTP1 prom.) | P7783 | 4613 | Inc. fruit weight |
| G2484 | 682 | Z-C4HC3 (202-250) | P5318 (shoot apical meristem-expressed STM prom.) | P7094 | 4522 | Inc. brix |
| G2484 | 682 | Z-C4HC3 (202-250) | P5319 (emergent leaf primordia-expressed AS1 prom.) | P7094 | 4522 | Inc. brix |
| G2499 | 684 | SWI/SNF (209-414, 618-701) | P5326 (floral meristem-expressed AP1 prom.) | P8561 | 4701 | Inc. fruit weight |
| G2505 | 686 | NAC (9-137) | P5284 (leaf-expressed RbcS3 prom.) | P4342 | 4282 | Inc. lycopene |
| G2510 | 688 | AP2 (42-109) | P5284 (leaf-expressed RbcS3 prom.) | P6906 | 4499 | Inc. brix |
| G2510 | 688 | AP2 (42-109) | P6506 (constitutive CaMv 35S prom.) | P6906 | 4499 | Waxy leaves |
| G2519 | 690 | HLH/MYC (1-54) | P6506 (constitutive CaMv 35S prom.) | P6875 | 4489 | Inc. brix |
| G2535 | 692 | NAC (11-114) | P5318 (shoot apical meristem-expressed STM prom.) | P4521 | 4306 | Inc. brix |
| G2546 | 694 | HB (349-413) | P5297 (fruit tissue-expressed PG prom.) | P4592 | 4319 | Inc. brix |
| G2550 | 698 | HB (345-408) | P5326 (floral meristem-expressed AP1 prom.) | P8728 | 4753 | Inc. fruit weight |
| G2552 | 700 | HLH/MYC (124-181) | P5319 (emergent leaf primordia-expressed AS1 prom.) | P4757 | 4346 | Inc. biomass |
| G2553 | 702 | HLH/MYC (538-598) | P5297 (fruit tissue-expressed PG prom.) | P7527 | 4573 | Inc. lycopene |
| G2554 | 704 | HLH/MYC (338-398) | P5326 (floral meristem-expressed AP1 prom.) | P7576 | 4586 | Inc. fruit weight |
| G2554 | 704 | HLH/MYC (338-398) | P5287 (epidermal tissue-expressed LTP1 prom.) | P7576 | 4586 | Inc. fruit weight |
| G2555 | 706 | HLH/MYC (184-242) | P5284 (leaf-expressed RbcS3 prom.) | P7103 | 4523 | Inc. lycopene |
| G2555 | 706 | HLH/MYC (184-242) | P5318 (shoot apical meristem-expressed STM prom.) | P7103 | 4523 | Inc. fruit weight |
| G2555 | 706 | HLH/MYC (184-242) | P6506 (constitutive CaMv 35S prom.) | P7103 | 4523 | Inc. biomass |
| G2556 | 708 | HLH/MYC (546-606) | P5310 (root-expressed RSI1 prom.) | P8720 | 4750 | Inc. brix |
| G2556 | 708 | HLH/MYC (546-606) | P5297 (fruit tissue-expressed PG prom.) | P8720 | 4750 | Inc. fruit weight |
| G2556 | 708 | HLH/MYC (546-606) | P5287 (epidermal tissue-expressed LTP1 prom.) | P8720 | 4750 | Inc. fruit weight |
| G2573 | 710 | AP2 (31-98) | P5284 (leaf-expressed RbcS3 prom.) | P4715 | 4332 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2573 | 710 | AP2 (31-98) | P5284 (leaf-expressed RbcS3 prom.) | P4715 | 4332 | Inc. lycopene |
| G2574 | 712 | WRKY (225-284) | P5310 (root-expressed RSI1 prom.) | P7507 | 4564 | Inc. brix |
| G2575 | 714 | WRKY (137-192) | P5326 (floral meristem-expressed AP1 prom.) | P8238 | 4674 | Inc. fruit weight |
| G2575 | 714 | WRKY (137-192) | P5318 (shoot apical meristem-expressed STM prom.) | P8238 | 4674 | Inc. fruit weight |
| G2575 | 714 | WRKY (137-192) | P5284 (leaf-expressed RbcS3 prom.) | P8238 | 4674 | Inc. fruit weight |
| G2577 | 716 | AP2 (208-281, 307-375) | P5310 (root-expressed RSI1 prom.) | P8647 | 4729 | Inc. brix |
| G2577 | 716 | AP2 (208-281, 307-375) | P5318 (shoot apical meristem-expressed STM prom.) | P8647 | 4729 | Inc. brix |
| G2579 | 718 | AP2 (52-119) | P5287 (epidermal tissue-expressed LTP1 prom.) | P9029 | 4766 | Inc. fruit weight |
| G2579 | 718 | AP2 (52-119) | P5326 (floral meristem-expressed AP1 prom.) | P9029 | 4766 | Inc. fruit weight |
| G2582 | 722 | MADS (1-57) | P5310 (root-expressed RSI1 prom.) | P9174 | 4804 | Inc. lycopene |
| G2582 | 722 | MADS (1-57) | P5326 (floral meristem-expressed AP1 prom.) | P9174 | 4804 | Inc. fruit weight |
| G2586 | 724 | WRKY (103-160) | P5310 (root-expressed RSI1 prom.) | P8722 | 4751 | Inc. lycopene |
| G2604 | 730 | Z-LSDlike (34-64, 73-103) | P6506 (constitutive CaMv 35S prom.) | P7700 | 4592 | Inc. fruit weight |
| G2604 | 730 | Z-LSDlike (34-64, 73-103) | P5303 (fruit tissue-expressed PD prom.) | P7700 | 4592 | Inc. fruit weight |
| G2606 | 732 | Z-C2H2 (120-140, 192-214) | P5287 (epidermal tissue-expressed LTP1 prom.) | P7753 | 4604 | Inc. lycopene |
| G2616 | 736 | HB (79-139) | P5326 (floral meristem-expressed AP1 prom.) | P8735 | 4758 | Inc. fruit weight |
| G2620 | 740 | TH (118-193) | P5297 (fruit tissue-expressed PG prom.) | P8643 | 4728 | Inc. brix |
| G2632 | 742 | CAAT (166-223) | P5284 (leaf-expressed RbcS3 prom.) | P8662 | 4734 | Inc. fruit weight |
| G2639 | 744 | SRS (114-167) | P5310 (root-expressed RSI1 prom.) | | | Inc. lycopene |
| G2639 | 744 | SRS (114-167) | P5318 (shoot apical meristem-expressed STM prom.) | | | Inc. fruit weight |
| G2639 | 744 | SRS (114-167) | P5284 (leaf-expressed RbcS3 prom.) | | | Inc. fruit weight |
| G2639 | 744 | SRS (114-167) | P5326 (floral meristem-expressed AP1 prom.) | | | Inc. fruit weight |
| G2639 | 744 | SRS (114-167) | P5287 (epidermal tissue-expressed LTP1 prom.) | | | Inc. fruit weight |
| G2640 | 748 | SRS (146-189) | P5310 (root-expressed RSI1 prom.) | P9243 | 4814 | Inc. lycopene |
| G2650 | 752 | TEO (34-91) | P5318 (shoot apical meristem-expressed STM prom.) | P8144 | 4647 | Inc. lycopene |
| G2650 | 752 | TEO (34-91) | P5297 (fruit tissue-expressed PG prom.) | P8144 | 4647 | Inc. lycopene |
| G2655 | 754 | HLH/MYC (119-178) | P6506 (constitutive CaMv 35S prom.) | P7531 | 4574 | Inc. brix |
| G2655 | 754 | HLH/MYC (119-178) | P5326 (floral meristem-expressed AP1 prom.) | P7531 | 4574 | Inc. fruit weight |
| G2656 | 756 | DBP (173-292) | P5284 (leaf-expressed RbcS3 prom.) | P9176 | 4805 | Inc. lycopene |
| G2656 | 756 | DBP (173-292) | P5310 (root-expressed RSI1 prom.) | P9176 | 4805 | Inc. lycopene |
| G2656 | 756 | DBP (173-292) | P5318 (shoot apical meristem-expressed STM prom.) | P9176 | 4805 | Inc. fruit weight |
| G2656 | 756 | DBP (173-292) | P5326 (floral meristem-expressed AP1 prom.) | P9176 | 4805 | Inc. fruit weight |
| G2661 | 758 | HLH/MYC (40-97) | P5287 (epidermal tissue-expressed LTP1 prom.) | P9177 | 4806 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2661 | 758 | HLH/MYC (40-97) | P5326 (floral meristem-expressed AP1 prom.) | P9177 | 4806 | Inc. fruit weight |
| G2674 | 760 | HB (56-116) | P5310 (root-expressed RSI1 prom.) | P9272 | 4822 | Inc. brix |
| G2674 | 760 | HB (56-116) | P5287 (epidermal tissue-expressed LTP1 prom.) | P9272 | 4822 | Inc. fruit weight |
| G2674 | 760 | HB (56-116) | P5318 (shoot apical meristem-expressed STM prom.) | P9272 | 4822 | Inc. fruit weight |
| G2674 | 760 | HB (56-116) | P5297 (fruit tissue-expressed PG prom.) | P9272 | 4822 | Inc. fruit weight |
| G2674 | 760 | HB (56-116) | P5284 (leaf-expressed RbcS3 prom.) | P9272 | 4822 | Inc. fruit weight |
| G2682 | 764 | CPP (67-181) | P5284 (leaf-expressed RbcS3 prom.) | P8241 | 4676 | Inc. lycopene |
| G2686 | 766 | WRKY (122-173) | P5287 (epidermal tissue-expressed LTP1 prom.) | P8080 | 4640 | Inc. brix |
| G2686 | 766 | WRKY (122-173) | P5284 (leaf-expressed RbcS3 prom.) | P8080 | 4640 | Inc. lycopene |
| G2688 | 768 | WRKY (67-124) | P5319 (emergent leaf primordia-expressed AS1 prom.) | P7508 | 4565 | Inc. brix |
| G2688 | 768 | WRKY (67-124) | P5297 (fruit tissue-expressed PG prom.) | P7508 | 4565 | Inc. brix |
| G2688 | 768 | WRKY (67-124) | P5287 (epidermal tissue-expressed LTP1 prom.) | P7508 | 4565 | Inc. brix |
| G2688 | 768 | WRKY (67-124) | P6506 (constitutive CaMv 35S prom.) | P7508 | 4565 | Inc. brix |
| G2696 | 770 | SCR (330-398, 545-621) | P5326 (floral meristem-expressed AP1 prom.) | P8161 | 4650 | Inc. fruit weight |
| G2697 | 772 | SCR (233-298, 361-449, 453-525) | P5318 (shoot apical meristem-expressed STM prom.) | P8636 | 4725 | Inc. brix |
| G2697 | 772 | SCR (233-298, 361-449, 453-525) | P5310 (root-expressed RSI1 prom.) | P8636 | 4725 | Inc. lycopene |
| G2699 | 774 | SCR (107-172, 243-333, 333-407) | P5287 (epidermal tissue-expressed LTP1 prom.) | P7759 | 4606 | Inc. brix |
| G2699 | 774 | SCR (107-172, 243-333, 333-407) | P5297 (fruit tissue-expressed PG prom.) | P7759 | 4606 | Inc. lycopene |
| G2699 | 774 | SCR (107-172, 243-333, 333-407) | P5284 (leaf-expressed RbcS3 prom.) | P7759 | 4606 | Inc. lycopene |
| G2704 | 776 | MYB-(R1)R2R3 (158-258) | P5310 (root-expressed RSI1 prom.) | P9039 | 4768 | Inc. lycopene |
| G2710 | 778 | HB (55-115) | P5310 (root-expressed RSI1 prom.) | P8513 | 4691 | Inc. brix |
| G2710 | 778 | HB (55-115) | P5318 (shoot apical meristem-expressed STM prom.) | P8513 | 4691 | Inc. lycopene |
| G2710 | 778 | HB (55-115) | P5287 (epidermal tissue-expressed LTP1 prom.) | P8513 | 4691 | Inc. lycopene |
| G2712 | 780 | HB (65-125) | P5318 (shoot apical meristem-expressed STM prom.) | P8163 | 4651 | Inc. fruit weight |
| G2715 | 782 | MYB-(R1)R2R3 (25-110) | P5326 (floral meristem-expressed AP1 prom.) | P4721 | 4333 | Inc. brix |
| G2719 | 784 | MYB-(R1)R2R3 (56-154) | P5287 (epidermal tissue-expressed LTP1 prom.) | P4723 | 4335 | Inc. brix |
| G2719 | 784 | MYB-(R1)R2R3 (56-154) | P5318 (shoot apical meristem-expressed STM prom.) | P4723 | 4335 | Inc. lycopene |
| G2719 | 784 | MYB-(R1)R2R3 (56-154) | P5287 (epidermal tissue-expressed LTP1 prom.) | P4723 | 4335 | Inc. lycopene |
| G2720 | 786 | MYB-(R1)R2R3 (10-114) | P5284 (leaf-expressed RbcS3 prom.) | P4722 | 4334 | Inc. brix |
| G2720 | 786 | MYB-(R1)R2R3 (10-114) | P5297 (fruit tissue-expressed PG prom.) | P4722 | 4334 | Inc. brix |
| G2721 | 788 | MYB-related (10-60) | P5324 (fruit vascular tissue-expressed Cru prom.) | P7734 | 4598 | Inc. biomass |
| G2723 | 790 | MYB-related (10-60) | P5287 (epidermal tissue-expressed LTP1 prom.) | P9190 | 4809 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2724 | 792 | MYB-(R1)R2R3 (7-113) | P5284 (leaf-expressed RbcS3 prom.) | P4727 | 4337 | Inc. lycopene |
| G2739 | 796 | SCR (243-309, 368-457, 466-541) | P5297 (fruit tissue-expressed PG prom.) | P8743 | 4761 | Inc. fruit weight |
| G2739 | 796 | SCR (243-309, 368-457, 466-541) | P5318 (shoot apical meristem-expressed STM prom.) | P8743 | 4761 | Inc. fruit weight |
| G2739 | 796 | SCR (243-309, 368-457, 466-541) | P5326 (floral meristem-expressed AP1 prom.) | P8743 | 4761 | Inc. fruit weight |
| G2739 | 796 | SCR (243-309, 368-457, 466-541) | P5284 (leaf-expressed RbcS3 prom.) | P8743 | 4761 | Inc. fruit weight |
| G2742 | 800 | GARP (28-76) | P5287 (epidermal tissue-expressed LTP1 prom.) | P8637 | 4726 | Inc. fruit weight |
| G2747 | 802 | ABI3/VP-1 (19-113) | P5287 (epidermal tissue-expressed LTP1 prom.) | P8127 | 4643 | Inc. brix |
| G2747 | 802 | ABI3/VP-1 (19-113) | P5326 (floral meristem-expressed AP1 prom.) | P8127 | 4643 | Inc. brix |
| G2747 | 802 | ABI3/VP-1 (19-113) | P5297 (fruit tissue-expressed PG prom.) | P8127 | 4643 | Inc. brix |
| G2747 | 802 | ABI3/VP-1 (19-113) | P5287 (epidermal tissue-expressed LTP1 prom.) | P8127 | 4643 | Inc. lycopene |
| G2748 | 804 | TEO (51-108) | P5303 (fruit tissue-expressed PD prom.) | P8126 | 4642 | Inc. brix |
| G2748 | 804 | TEO (51-108) | P5326 (floral meristem-expressed AP1 prom.) | P8126 | 4642 | Inc. lycopene |
| G2750 | 806 | AKR (231-719) | P5284 (leaf-expressed RbcS3 prom.) | P8215 | 4660 | Inc. lycopene |
| G2754 | 808 | SWI/SNF (198-393, 554-638) | P5318 (shoot apical meristem-expressed STM prom.) | P8655 | 4731 | Inc. fruit weight |
| G2766 | 810 | HLH/MYC (234-292) | P5310 (root-expressed RSI1 prom.) | P8606 | 4713 | Inc. lycopene |
| G2766 | 810 | HLH/MYC (234-292) | P6506 (constitutive CaMv 35S prom.) | P8606 | 4713 | Inc. fruit weight |
| G2774 | 814 | HLH/MYC (158-215) | P5284 (leaf-expressed RbcS3 prom.) | P8725 | 4752 | Inc. brix |
| G2779 | 816 | HLH/MYC (148-206) | P5297 (fruit tissue-expressed PG prom.) | P9060 | 4773 | Inc. brix |
| G2789 | 818 | AT-hook (59-67, 68-208) | P5287 (epidermal tissue-expressed LTP1 prom.) | P4750 | 4343 | Inc. fruit weight |
| G2790 | 822 | HLH/MYC (141-198) | P5287 (epidermal tissue-expressed LTP1 prom.) | P7497 | 4563 | Inc. brix |
| G2790 | 822 | HLH/MYC (141-198) | P5284 (leaf-expressed RbcS3 prom.) | P7497 | 4563 | Inc. lycopene |
| G2791 | 824 | HLH/MYC (102-159) | P5284 (leaf-expressed RbcS3 prom.) | P8133 | 4644 | Inc. brix |
| G2791 | 824 | HLH/MYC (102-159) | P5326 (floral meristem-expressed AP1 prom.) | P8133 | 4644 | Inc. brix |
| G2791 | 824 | HLH/MYC (102-159) | P5287 (epidermal tissue-expressed LTP1 prom.) | P8133 | 4644 | Inc. brix |
| G2791 | 824 | HLH/MYC (102-159) | P5284 (leaf-expressed RbcS3 prom.) | P8133 | 4644 | Inc. lycopene |
| G2791 | 824 | HLH/MYC (102-159) | P5326 (floral meristem-expressed AP1 prom.) | P8133 | 4644 | Inc. lycopene |
| G2792 | 826 | HLH/MYC (307-364) | P5326 (floral meristem-expressed AP1 prom.) | P8731 | 4755 | Inc. brix |
| G2800 | 832 | NAC (11-150) | P5297 (fruit tissue-expressed PG prom.) | P8536 | 4694 | Inc. brix |
| G2800 | 832 | NAC (11-150) | P5318 (shoot apical meristem-expressed STM prom.) | P8536 | 4694 | Inc. brix |
| G2802 | 834 | NAC (48-196) | P5287 (epidermal tissue-expressed LTP1 prom.) | P8660 | 4733 | Inc. fruit weight |
| G2803 | 836 | NAC (8-160) | P5318 (shoot apical meristem-expressed STM prom.) | P7594 | 4589 | Inc. fruit weight |
| G2803 | 836 | NAC (8-160) | P5287 (epidermal tissue-expressed LTP1 prom.) | P7594 | 4589 | Inc. fruit weight |
| G2803 | 836 | NAC (8-160) | P5326 (floral meristem-expressed AP1 prom.) | P7594 | 4589 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2803 | 836 | NAC (8-160) | P5284 (leaf-expressed RbcS3 prom.) | P7594 | 4589 | Inc. fruit weight |
| G2804 | 838 | NAC (38-130) | P5287 (epidermal tissue-expressed LTP1 prom.) | P8741 | 4760 | Inc. fruit weight |
| G2809 | 840 | HB (95-155) | P5326 (floral meristem-expressed AP1 prom.) | P8681 | 4742 | Inc. lycopene |
| G2818 | 842 | SWI/SNF (24-239, 456-539) | P5326 (floral meristem-expressed AP1 prom.) | P8585 | 4707 | Inc. fruit weight |
| G2826 | 844 | Z-C2H2 (75-95) | P5318 (shoot apical meristem-expressed STM prom.) | P7727 | 4597 | Inc. lycopene |
| G2826 | 844 | Z-C2H2 (75-95) | P5287 (epidermal tissue-expressed LTP1 prom.) | P7727 | 4597 | Inc. lycopene |
| G2826 | 844 | Z-C2H2 (75-95) | P5284 (leaf-expressed RbcS3 prom.) | P7727 | 4597 | Inc. lycopene |
| G2831 | 846 | Z-C2H2 (72-92, 148-168) | P5318 (shoot apical meristem-expressed STM prom.) | P8618 | 4719 | Inc. fruit weight |
| G2831 | 846 | Z-C2H2 (72-92, 148-168) | P5297 (fruit tissue-expressed PG prom.) | P8618 | 4719 | Inc. fruit weight |
| G2836 | 848 | Z-C2H2 (160-181) | P5326 (floral meristem-expressed AP1 prom.) | P7765 | 4608 | Inc. brix |
| G2837 | 850 | Z-C2H2 (140-160) | P5303 (fruit tissue-expressed PD prom.) | P8625 | 4722 | Inc. brix |
| G2837 | 850 | Z-C2H2 (140-160) | P5303 (fruit tissue-expressed PD prom.) | P8625 | 4722 | Inc. lycopene |
| G2837 | 850 | Z-C2H2 (140-160) | P5297 (fruit tissue-expressed PG prom.) | P8625 | 4722 | Inc. lycopene |
| G2838 | 852 | Z-C2H2 (57-77) | P5318 (shoot apical meristem-expressed STM prom.) | P8578 | 4705 | Inc. brix |
| G2838 | 852 | Z-C2H2 (57-77) | P6506 (constitutive CaMv 35S prom.) | P8578 | 4705 | Large flowers |
| G2840 | 854 | Z-C2H2 (246-266, 297-328, 335-356) | P5326 (floral meristem-expressed AP1 prom.) | P7741 | 4601 | Inc. brix |
| G2848 | 856 | HLH/MYC (29-83) | P5318 (shoot apical meristem-expressed STM prom.) | P7573 | 4585 | Inc. fruit weight |
| G2848 | 856 | HLH/MYC (29-83) | P5297 (fruit tissue-expressed PG prom.) | P7573 | 4585 | Inc. fruit weight |
| G2848 | 856 | HLH/MYC (29-83) | P5326 (floral meristem-expressed AP1 prom.) | P7573 | 4585 | Inc. fruit weight |
| G2848 | 856 | HLH/MYC (29-83) | P5287 (epidermal tissue-expressed LTP1 prom.) | P7573 | 4585 | Inc. fruit weight |
| G2849 | 858 | HLH/MYC (28-81) | P5297 (fruit tissue-expressed PG prom.) | P7784 | 4614 | Inc. brix |
| G2849 | 858 | HLH/MYC (28-81) | P5297 (fruit tissue-expressed PG prom.) | P7784 | 4614 | Inc. lycopene |
| G2855 | 862 | ACBF-like (105-285) | P5310 (root-expressed RSI1 prom.) | P8690 | 4745 | Inc. brix |
| G2855 | 862 | ACBF-like (105-285) | P5310 (root-expressed RSI1 prom.) | P8690 | 4745 | Inc. lycopene |
| G2855 | 862 | ACBF-like (105-285) | P5287 (epidermal tissue-expressed LTP1 prom.) | P8690 | 4745 | Inc. fruit weight |
| G2855 | 862 | ACBF-like (105-285) | P5284 (leaf-expressed RbcS3 prom.) | P8690 | 4745 | Inc. fruit weight |
| G2855 | 862 | ACBF-like (105-285) | P5318 (shoot apical meristem-expressed STM prom.) | P8690 | 4745 | Inc. fruit weight |
| G2855 | 862 | ACBF-like (105-285) | P5326 (floral meristem-expressed AP1 prom.) | P8690 | 4745 | Inc. fruit weight |
| G2856 | 864 | ACBF-like (25-335) | P5297 (fruit tissue-expressed PG prom.) | | | Inc. lycopene |
| G2856 | 864 | ACBF-like (25-335) | P5287 (epidermal tissue-expressed LTP1 prom.) | | | Inc. fruit weight |
| G2856 | 864 | ACBF-like (25-335) | P5318 (shoot apical meristem-expressed STM prom.) | | | Inc. fruit weight |
| G2876 | 868 | AKR (152-653) | P5297 (fruit tissue-expressed PG prom.) | | | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2885 | 872 | GARP (196-243) | P5287 (epidermal tissue-expressed LTP1 prom.) | P8143 | 4646 | Inc. brix |
| G2885 | 872 | GARP (196-243) | P5287 (epidermal tissue-expressed LTP1 prom.) | P8143 | 4646 | Inc. lycopene |
| G2887 | 874 | NAC (4-180) | P5326 (floral meristem-expressed AP1 prom.) | P8178 | 4656 | Inc. fruit weight |
| G2891 | 876 | AKR (92-594) | P5287 (epidermal tissue-expressed LTP1 prom.) | P9228 | 4813 | Inc. lycopene |
| G2891 | 876 | AKR (92-594) | P5284 (leaf-expressed RbcS3 prom.) | P9228 | 4813 | Inc. lycopene |
| G2891 | 876 | AKR (92-594) | P5310 (root-expressed RSI1 prom.) | P9228 | 4813 | Inc. lycopene |
| G2893 | 878 | MYB-(R1)R2R3 (19-120) | P5326 (floral meristem-expressed AP1 prom.) | P4729 | 4338 | Inc. lycopene |
| G2893 | 878 | MYB-(R1)R2R3 (19-120) | P5318 (shoot apical meristem-expressed STM prom.) | P4729 | 4338 | Inc. fruit weight |
| G2896 | 880 | HMG (30-102) | P5326 (floral meristem-expressed AP1 prom.) | P7588 | 4588 | Inc. lycopene |
| G2896 | 880 | HMG (30-102) | P5297 (fruit tissue-expressed PG prom.) | P7588 | 4588 | Inc. lycopene |
| G2898 | 882 | HMG (59-131) | P5326 (floral meristem-expressed AP1 prom.) | P8141 | 4645 | Inc. brix |
| G2898 | 882 | HMG (59-131) | P5284 (leaf-expressed RbcS3 prom.) | P8141 | 4645 | Inc. lycopene |
| G2898 | 882 | HMG (59-131) | P5297 (fruit tissue-expressed PG prom.) | P8141 | 4645 | Inc. lycopene |
| G2898 | 882 | HMG (59-131) | P5326 (floral meristem-expressed AP1 prom.) | P8141 | 4645 | Inc. lycopene |
| G2898 | 882 | HMG (59-131) | P5287 (epidermal tissue-expressed LTP1 prom.) | P8141 | 4645 | Inc. lycopene |
| G2902 | 888 | HMG (128-198, 242-311, 371-441) | P5284 (leaf-expressed RbcS3 prom.) | P8738 | 4759 | Inc. lycopene |
| G2902 | 888 | HMG (128-198, 242-311, 371-441) | P5318 (shoot apical meristem-expressed STM prom.) | P8738 | 4759 | Inc. lycopene |
| G2902 | 888 | HMG (128-198, 242-311, 371-441) | P5310 (root-expressed RSI1 prom.) | P8738 | 4759 | Inc. lycopene |
| G2906 | 890 | Z-C2H2 (119-140) | P5287 (epidermal tissue-expressed LTP1 prom.) | P7599 | 4591 | Inc. fruit weight |
| G2906 | 890 | Z-C2H2 (119-140) | P5324 (fruit vascular tissue-expressed Cru prom.) | P7599 | 4591 | Inc. fruit weight |
| G2906 | 890 | Z-C2H2 (119-140) | P5318 (shoot apical meristem-expressed STM prom.) | P7599 | 4591 | Inc. fruit weight |
| G2906 | 890 | Z-C2H2 (119-140) | P5284 (leaf-expressed RbcS3 prom.) | P7599 | 4591 | Inc. fruit weight |
| G2910 | 892 | PCGL (22-130, 778-847) | P5310 (root-expressed RSI1 prom.) | P8702 | 4749 | Inc. lycopene |
| G2918 | 894 | JUMONJI (108-143, 294-446) | P5326 (floral meristem-expressed AP1 prom.) | P8620 | 4720 | Inc. brix |
| G2918 | 894 | JUMONJI (108-143, 294-446) | P5284 (leaf-expressed RbcS3 prom.) | P8620 | 4720 | Inc. fruit weight |
| G2921 | 896 | JUMONJI (55-119, 267-419) | P5287 (epidermal tissue-expressed LTP1 prom.) | P8596 | 4712 | Inc. fruit weight |
| G2927 | 898 | HLH/MYC (341-398) | P5284 (leaf-expressed RbcS3 prom.) | P8564 | 4702 | Inc. fruit weight |
| G2929 | 900 | HLH/MYC (70-130) | P5284 (leaf-expressed RbcS3 prom.) | P8656 | 4732 | Inc. fruit weight |
| G2929 | 900 | HLH/MYC (70-130) | P5287 (epidermal tissue-expressed LTP1 prom.) | P8656 | 4732 | Inc. fruit weight |
| G2929 | 900 | HLH/MYC (70-130) | P5326 (floral meristem-expressed AP1 prom.) | P8656 | 4732 | Inc. fruit weight |
| G2930 | 902 | HLH/MYC (57-120) | P5297 (fruit tissue-expressed PG prom.) | P7565 | 4581 | Inc. brix |
| G2930 | 902 | HLH/MYC (57-120) | P6506 (constitutive CaMv 35S prom.) | P7565 | 4581 | Inc. brix |
| G2930 | 902 | HLH/MYC (57-120) | P5284 (leaf-expressed RbcS3 prom.) | P7565 | 4581 | Inc. brix |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G2931 | 904 | HLH/MYC (71-131) | P5287 (epidermal tissue-expressed LTP1 prom.) | P9179 | 4807 | Inc. fruit weight |
| G2931 | 904 | HLH/MYC (71-131) | P5284 (leaf-expressed RbcS3 prom.) | P9179 | 4807 | Inc. fruit weight |
| G2936 | 906 | HLH/MYC (82-142) | P5310 (root-expressed RSI1 prom.) | P9180 | 4808 | Inc. lycopene |
| G2936 | 906 | HLH/MYC (82-142) | P5318 (shoot apical meristem-expressed STM prom.) | P9180 | 4808 | Inc. fruit weight |
| G2936 | 906 | HLH/MYC (82-142) | P5284 (leaf-expressed RbcS3 prom.) | P9180 | 4808 | Inc. fruit weight |
| G2965 | 912 | Z-C2H2 (49-70) | P5284 (leaf-expressed RbcS3 prom.) | P7709 | 4594 | Inc. fruit weight |
| G2966 | 914 | Z-C2H2 (233-254) | P5326 (floral meristem-expressed AP1 prom.) | P8490 | 4685 | Inc. fruit weight |
| G2972 | 916 | Z-C2H2 (8-32, 129-149, 277-294) | P5284 (leaf-expressed RbcS3 prom.) | P7597 | 4590 | Inc. fruit weight |
| G2979 | 918 | E2F (192-211) | P5310 (root-expressed RSI1 prom.) | P8685 | 4743 | Inc. lycopene |
| G2980 | 920 | E2F (39-337) | P5318 (shoot apical meristem-expressed STM prom.) | P8686 | 4744 | Inc. fruit weight |
| G2982 | 922 | E2F (107-124) | P5326 (floral meristem-expressed AP1 prom.) | P8515 | 4692 | Inc. brix |
| G2982 | 922 | E2F (107-124) | P5297 (fruit tissue-expressed PG prom.) | P8515 | 4692 | Inc. brix |
| G2983 | 924 | HB (88-148) | P5297 (fruit tissue-expressed PG prom.) | P8539 | 4696 | Inc. brix |
| G2983 | 924 | HB (88-148) | P5310 (root-expressed RSI1 prom.) | P8539 | 4696 | Inc. lycopene |
| G2985 | 926 | OTHER (353-488) | P5287 (epidermal tissue-expressed LTP1 prom.) | P8221 | 4662 | Inc. fruit weight |
| G2985 | 926 | OTHER (353-488) | P5310 (root-expressed RSI1 prom.) | P8221 | 4662 | Inc. fruit weight |
| G2985 | 926 | OTHER (353-488) | P5318 (shoot apical meristem-expressed STM prom.) | P8221 | 4662 | Inc. fruit weight |
| G2989 | 928 | ZF-HB (50-105, 192-255) | P5284 (leaf-expressed RbcS3 prom.) | P7514 | 4569 | Inc. lycopene |
| G2989 | 928 | ZF-HB (50-105, 192-255) | P5284 (leaf-expressed RbcS3 prom.) | P7514 | 4569 | Inc. brix |
| G2990 | 930 | ZF-HB (54-109, 200-263) | P5287 (epidermal tissue-expressed LTP1 prom.) | P7515 | 4570 | Inc. fruit weight |
| G2992 | 932 | ZF-HB (29-84, 156-219) | P5326 (floral meristem-expressed AP1 prom.) | P8122 | 4641 | Inc. brix |
| G2992 | 932 | ZF-HB (29-84, 156-219) | P5318 (shoot apical meristem-expressed STM prom.) | P8122 | 4641 | Inc. brix |
| G2992 | 932 | ZF-HB (29-84, 156-219) | P5287 (epidermal tissue-expressed LTP1 prom.) | P8122 | 4641 | Inc. brix |
| G2992 | 932 | ZF-HB (29-84, 156-219) | P5297 (fruit tissue-expressed PG prom.) | P8122 | 4641 | Inc. brix |
| G2992 | 932 | ZF-HB (29-84, 156-219) | P5318 (shoot apical meristem-expressed STM prom.) | P8122 | 4641 | Inc. lycopene |
| G2992 | 932 | ZF-HB (29-84, 156-219) | P5326 (floral meristem-expressed AP1 prom.) | P8122 | 4641 | Inc. lycopene |
| G2993 | 934 | ZF-HB (85-138, 222-285) | P5297 (fruit tissue-expressed PG prom.) | P7787 | 4616 | Inc. brix |
| G2995 | 936 | ZF-HB (3-58, 115-178) | P5319 (emergent leaf primordia-expressed AS1 prom.) | P7516 | 4571 | Inc. fruit weight |
| G2996 | 938 | ZF-HB (73-126, 191-254) | P5297 (fruit tissue-expressed PG prom.) | P7513 | 4568 | Inc. fruit weight |
| G2998 | 940 | ZF-HB (74-127, 240-303) | P5284 (leaf-expressed RbcS3 prom.) | P7517 | 4572 | Inc. brix |
| G2999 | 942 | ZF-HB (80-133, 198-261) | P5310 (root-expressed RSI1 prom.) | P8587 | 4709 | Inc. brix |
| G2999 | 942 | ZF-HB (80-133, 198-261) | P5310 (root-expressed RSI1 prom.) | P8587 | 4709 | Inc. lycopene |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G3006 | 948 | HS (38-153) | P5284 (leaf-expressed RbcS3 prom.) | P9059 | 4772 | Inc. fruit weight |
| G3006 | 948 | HS (38-153) | P5318 (shoot apical meristem-expressed STM prom.) | P9059 | 4772 | Inc. fruit weight |
| G3006 | 948 | HS (38-153) | P5297 (fruit tissue-expressed PG prom.) | P9059 | 4772 | Inc. fruit weight |
| G3006 | 948 | HS (38-153) | P5326 (floral meristem-expressed AP1 prom.) | P9059 | 4772 | Inc. fruit weight |
| G3007 | 950 | TUBBY (21-137, 141-188) | P5326 (floral meristem-expressed AP1 prom.) | P8680 | 4741 | Inc. fruit weight |
| G3007 | 950 | TUBBY (21-137, 141-188) | P5284 (leaf-expressed RbcS3 prom.) | P8680 | 4741 | Inc. fruit weight |
| G3007 | 950 | TUBBY (21-137, 141-188) | P5318 (shoot apical meristem-expressed STM prom.) | P8680 | 4741 | Inc. fruit weight |
| G3007 | 950 | TUBBY (21-137, 141-188) | P5287 (epidermal tissue-expressed LTP1 prom.) | P8680 | 4741 | Inc. fruit weight |
| G3009 | 952 | SCR (228-293, 350-437, 441-515) | P5284 (leaf-expressed RbcS3 prom.) | P8491 | 4686 | Inc. lycopene |
| G3012 | 954 | HLH/MYC (257-314) | P5297 (fruit tissue-expressed PG prom.) | P7568 | 4583 | Inc. brix |
| G3012 | 954 | HLH/MYC (257-314) | P5287 (epidermal tissue-expressed LTP1 prom.) | P7568 | 4583 | Inc. lycopene |
| G3021 | 956 | HLH/MYC (91-148) | P5318 (shoot apical meristem-expressed STM prom.) | P7566 | 4582 | Inc. brix |
| G3021 | 956 | HLH/MYC (91-148) | P5287 (epidermal tissue-expressed LTP1 prom.) | P7566 | 4582 | Inc. lycopene |
| G3023 | 958 | HLH/MYC (8-68) | P5287 (epidermal tissue-expressed LTP1 prom.) | P7571 | 4584 | Inc. fruit weight |
| G3023 | 958 | HLH/MYC (8-68) | P5318 (shoot apical meristem-expressed STM prom.) | P7571 | 4584 | Inc. fruit weight |
| G3032 | 960 | GARP (285-333) | P5318 (shoot apical meristem-expressed STM prom.) | P8674 | 4739 | Inc. fruit weight |
| G3034 | 962 | GARP (218-266) | P5326 (floral meristem-expressed AP1 prom.) | P9194 | 4810 | Inc. fruit weight |
| G3037 | 964 | NAC (15-142) | P5318 (shoot apical meristem-expressed STM prom.) | P8621 | 4721 | Inc. fruit weight |
| G3037 | 964 | NAC (15-142) | P5287 (epidermal tissue-expressed LTP1 prom.) | P8621 | 4721 | Inc. fruit weight |
| G3037 | 964 | NAC (15-142) | P5326 (floral meristem-expressed AP1 prom.) | P8621 | 4721 | Inc. fruit weight |
| G3040 | 966 | NAC (4-144) | P5326 (floral meristem-expressed AP1 prom.) | P8666 | 4735 | Inc. brix |
| G3041 | 968 | NAC (8-136) | P5284 (leaf-expressed RbcS3 prom.) | P8220 | 4661 | Inc. fruit weight |
| G3041 | 968 | NAC (8-136) | P5318 (shoot apical meristem-expressed STM prom.) | P8220 | 4661 | Inc. fruit weight |
| G3054 | 970 | Z-C3H (77-96, 149-168) | P5319 (emergent leaf primordia-expressed AS1 prom.) | P7494 | 4561 | Inc. brix |
| G3054 | 970 | Z-C3H (77-96, 149-168) | P5297 (fruit tissue-expressed PG prom.) | P7494 | 4561 | Inc. brix |
| G3054 | 970 | Z-C3H (77-96, 149-168) | P5303 (fruit tissue-expressed PD prom.) | P7494 | 4561 | Inc. brix |
| G3054 | 970 | Z-C3H (77-96, 149-168) | P5284 (leaf-expressed RbcS3 prom.) | P7494 | 4561 | Inc. brix |
| G3055 | 972 | Z-C3H (97-115, 178-197, 266-287) | P5297 (fruit tissue-expressed PG prom.) | P7745 | 4602 | Inc. brix |
| G3055 | 972 | Z-C3H (97-115, 178-197, 266-287) | P5284 (leaf-expressed RbcS3 prom.) | P7745 | 4602 | Inc. lycopene |
| G3060 | 976 | Z-C3H (42-61, 219-237) | P5326 (floral meristem-expressed AP1 prom.) | P8177 | 4655 | Inc. lycopene |
| G3063 | 978 | Z-C2H2 (63-83, 139-159) | P5318 (shoot apical meristem-expressed STM prom.) | P8640 | 4727 | Inc. fruit weight |

TABLE 7-continued

Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|
| G3063 | 978 | Z-C2H2 (63-83, 139-159) | P5287 (epidermal tissue-expressed LTP1 prom.) | P8640 | 4727 | Inc. fruit weight |
| G3063 | 978 | Z-C2H2 (63-83, 139-159) | P5284 (leaf-expressed RbcS3 prom.) | P8640 | 4727 | Inc. fruit weight |
| G3064 | 980 | Z-C2H2 (154-175) | P5297 (fruit tissue-expressed PG prom.) | P8495 | 4689 | Inc. fruit weight |
| G3066 | 982 | Z-C2H2 (80-101, 284-306) | P5319 (emergent leaf primordia-expressed AS1 prom.) | P7702 | 4593 | Inc. fruit weight |
| G3066 | 982 | Z-C2H2 (80-101, 284-306) | P5287 (epidermal tissue-expressed LTP1 prom.) | P7702 | 4593 | Inc. fruit weight |
| G3066 | 982 | Z-C2H2 (80-101, 284-306) | P5297 (fruit tissue-expressed PG prom.) | P7702 | 4593 | Inc. fruit weight |
| G3067 | 984 | Z-C2H2 (198-219) | P5318 (shoot apical meristem-expressed STM prom.) | P7495 | 4562 | Inc. lycopene |
| G3074 | 986 | CAAT (3-86) | P5287 (epidermal tissue-expressed LTP1 prom.) | P8166 | 4652 | Inc. brix |
| G3074 | 986 | CAAT (3-86) | P5326 (floral meristem-expressed AP1 prom.) | P8166 | 4652 | Inc. brix |
| G3075 | 988 | CAAT (111-192) | P5287 (epidermal tissue-expressed LTP1 prom.) | P7738 | 4600 | Inc. lycopene |
| G3080 | 990 | bZIP-ZW2 (76-106, 210-237) | P5318 (shoot apical meristem-expressed STM prom.) | P7546 | 4579 | Inc. fruit weight |
| G3090 | 994 | PLATZ (12-147) | P5310 (root-expressed RSI1 prom.) | P8676 | 4740 | Inc. brix |
| G3090 | 994 | PLATZ (12-147) | P5326 (floral meristem-expressed AP1 prom.) | P8676 | 4740 | Inc. lycopene |
| G3090 | 994 | PLATZ (12-147) | P5310 (root-expressed RSI1 prom.) | P8676 | 4740 | Inc. lycopene |
| G3090 | 994 | PLATZ (12-147) | P5297 (fruit tissue-expressed PG prom.) | P8676 | 4740 | Inc. lycopene |
| G3101 | 996 | Z-C2H2 (14-78) | P5287 (epidermal tissue-expressed LTP1 prom.) | P8555 | 4699 | Inc. brix |
| G3101 | 996 | Z-C2H2 (14-78) | P5287 (epidermal tissue-expressed LTP1 prom.) | P8555 | 4699 | Inc. lycopene |
| G3102 | 998 | Z-C2H2 (397-440) | P5310 (root-expressed RSI1 prom.) | P8733 | 4756 | Inc. brix |
| G3102 | 998 | Z-C2H2 (397-440) | P5318 (shoot apical meristem-expressed STM prom.) | P8733 | 4756 | Inc. fruit weight |
| G3111 | 1000 | RING/C3H2C3 (111-152) | P5287 (epidermal tissue-expressed LTP1 prom.) | | | Inc. lycopene |

Abbreviations for Table 7:
inc. - increased or greater, relative to control plants
Cru - Cruciferin promoter
PG - Polygalacturonase promoter
PD - Phytoene desaturase promoter
ABI3/VP1 - Abscisic Acid Insensitive/maize VP1 like proteins
ACBF - AC-rich Binding Factors
AKR - Aldo-Keto Reductase family proteins
ARF - Auxin Response Factor family
BPF-1 Box P-binding factor Family proteins
CAAT - CCAAT-box binding family proteins
CPP - Cysteine-rich Polycomb-like Proteins
DBP - DNA-Binding Protein; miscellaneous proteins that bind to DNA
EIL - Ethylene Insensitive 3-Like proteins
ENBP - pea Early Nodulin gene-Binding Proteins
GF14 - G-Box Factor 14-3-3 Homolog family
GARP - Golgi-Associated Retrograde Protein complex proteins
HLH - Helix-Loop-Helix proteins
HMG - High Mobility Group family proteins
HS - Heat Shock transcription factor proteins
MADS - MCM1, AGAMOUS, DEFICIENS, and SRF, serum response factor family proteins
MYB - Myeloblastosis proto-oncogene product-like family of TFs
MYC - similar to myelocytomatosis viral oncogene (v-Myc) family proteins
PCF - PCF1- and PCF2-like proteins
Pcomb - Polycomb group (Pc-G) family proteins
PLATZ - Plant AT-rich sequence and Zinc-binding protein family proteins TABLE 7-continued Polypeptides of the invention, their conserved domains, families and the traits conferred by overexpressing the polypeptides in tomato plants

| Col. 1 GID | Col. 2 SEQ ID NO: | Col. 3 TF family (conserved domain amino acid coordinates) | Col. 4 First construct (expression system) | Col. 5 Second construct containing TF | Col. 6 SEQ ID NO: of second construct | Col. 7 Experimental observation (trait relative to controls) |
|---|---|---|---|---|---|---|

PMR - Putative Myb-Related family proteins
SCR - SCARECROW family proteins
SRS - Short Internodes or SHI transcription factor family proteins
SWI/SNF - switching mating type (SWI) and sucrose non-fermenting-like chromatin remodeling factors
TEO - Teosinte branched1 like proteins
TH - Triple Helix family proteins
ZF-HB - (also ZF-HD) zinc finger - homeodomain family proteins Example VIII Orthologs and Paralogs of the Sequences of the Invention Table 8 lists sequences discovered to be orthologous or paralogous to a number of transcription factors of the instant Sequence Listing. The columns headings include, from left to right: Column 1: the SEQ ID NO; Column 2: the corresponding *Arabidopsis* Gene identification (GID) numbers; Column 3: the sequence type (DNA or protein, PRT); Column 4: the species from which the sequence derives; and Column 5: the relationship to other sequences in this table and the Sequence Listing.

TABLE 8

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1 | G1004 | DNA | A. thaliana | Predicted polypeptide sequence is paralogous to G1419, G43, G46, G29; orthologous to G3849 |
| 2 | G1004 | PRT | A. thaliana | Paralogous to G1419, G43, G46, G29; Orthologous to G3849 |
| 3 | G1006 | DNA | A. thaliana | Predicted polypeptide sequence is paralogous to G22, G28; orthologous to G3430, G3659, G3660, G3661, G3717, G3718, G3841, G3843, G3844, G3845, G3846, G3848, G3852, G3856, G3857, G3858, G3864, G3865, G4626, G5171 |
| 4 | G1006 | PRT | A. thaliana | Paralogous to G22, G28; Orthologous to G3430, G3659, G3660, G3661, G3717, G3718, G3841, G3843, G3844, G3845, G3846, G3848, G3852, G3856, G3857, G3858, G3864, G3865, G4626, G5171 |
| 5 | G1007 | DNA | A. thaliana | Predicted polypeptide sequence is paralogous to G1846 |
| 6 | G1007 | PRT | A. thaliana | Paralogous to G1846 |
| 7 | G1008 | DNA | A. thaliana | Predicted polypeptide sequence is paralogous to G2130 |
| 8 | G1008 | PRT | A. thaliana | Paralogous to G2130 |
| 13 | G1021 | DNA | A. thaliana | Predicted polypeptide sequence is paralogous to G224, G1466, G223 |
| 14 | G1021 | PRT | A. thaliana | Paralogous to G224, G1466, G223 |
| 17 | G1033 | DNA | A. thaliana | Predicted polypeptide sequence is paralogous to G1029, G279 |
| 18 | G1033 | PRT | A. thaliana | Paralogous to G1029, G279 |
| 21 | G1053 | DNA | A. thaliana | Predicted polypeptide sequence is paralogous to G2629 |
| 22 | G1053 | PRT | A. thaliana | Paralogous to G2629 |
| 23 | G1057 | DNA | A. thaliana | Predicted polypeptide sequence is paralogous to G3027 |
| 24 | G1057 | PRT | A. thaliana | Paralogous to G3027 |
| 25 | G1062 | DNA | A. thaliana | Predicted polypeptide sequence is paralogous to G1664 |
| 26 | G1062 | PRT | A. thaliana | Paralogous to G1664 |
| 27 | G1065 | DNA | A. thaliana | Predicted polypeptide sequence is paralogous to G602 |
| 28 | G1065 | PRT | A. thaliana | Paralogous to G602 |
| 29 | G1067 | DNA | A. thaliana | Predicted polypeptide sequence is paralogous to G1073, G2156; orthologous to G3399, G3400 |
| 30 | G1067 | PRT | A. thaliana | Paralogous to G1073, G2156; Orthologous to G3399, G3400 |
| 33 | G1076 | DNA | A. thaliana | Predicted polypeptide sequence is paralogous to G1075; orthologous to G3406, G3407, G3458, G3459, G3460, G3461 |
| 34 | G1076 | PRT | A. thaliana | Paralogous to G1075; Orthologous to G3406, G3407, G3458, G3459, G3460, G3461 |
| 35 | G1078 | DNA | A. thaliana | Predicted polypeptide sequence is paralogous to G577 |
| 36 | G1078 | PRT | A. thaliana | Paralogous to G577 |
| 45 | G1091 | DNA | A. thaliana | Predicted polypeptide sequence is paralogous to G2588 |
| 46 | G1091 | PRT | A. thaliana | Paralogous to G2588 |
| 49 | G1113 | DNA | A. thaliana | Predicted polypeptide sequence is paralogous to G911 |
| 50 | G1113 | PRT | A. thaliana | Paralogous to G911 |
| 53 | G1131 | DNA | A. thaliana | Predicted polypeptide sequence is paralogous to G2767 |
| 54 | G1131 | PRT | A. thaliana | Paralogous to G2767 |
| 55 | G1133 | DNA | A. thaliana | Predicted polypeptide sequence is paralogous to G1137 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 56 | G1133 | PRT | A. thaliana | Paralogous to G1137 |
| 57 | G1134 | DNA | A. thaliana | Predicted polypeptide sequence is paralogous to G2555 |
| 58 | G1134 | PRT | A. thaliana | Paralogous to G2555 |
| 59 | G1136 | DNA | A. thaliana | Predicted polypeptide sequence is paralogous to G584 |
| 60 | G1136 | PRT | A. thaliana | Paralogous to G584 |
| 61 | G1137 | DNA | A. thaliana | Predicted polypeptide sequence is paralogous to G1133 |
| 62 | G1137 | PRT | A. thaliana | Paralogous to G1133 |
| 63 | G1140 | DNA | A. thaliana | Predicted polypeptide sequence is paralogous to G861; orthologous to G3984, G3985, G3986, G3987, G3988, G3989, G3990, G3991, G3992, G3998, G3999, G4060 |
| 64 | G1140 | PRT | A. thaliana | Paralogous to G861; Orthologous to G3984, G3985, G3986, G3987, G3988, G3989, G3990, G3991, G3992, G3998, G3999, G4060 |
| 65 | G1141 | DNA | A. thaliana | Predicted polypeptide sequence is paralogous to G38 |
| 66 | G1141 | PRT | A. thaliana | Paralogous to G38 |
| 67 | G1146 | DNA | A. thaliana | Predicted polypeptide sequence is paralogous to G1149, G1152 |
| 68 | G1146 | PRT | A. thaliana | Paralogous to G1149, G1152 |
| 73 | G1198 | DNA | A. thaliana | Predicted polypeptide sequence is paralogous to G1806, G554, G555, G556, G558, G578, G629 |
| 74 | G1198 | PRT | A. thaliana | Paralogous to G1806, G554, G555, G556, G558, G578, G629 |
| 75 | G1211 | DNA | A. thaliana | Predicted polypeptide sequence is paralogous to G291 |
| 76 | G1211 | PRT | A. thaliana | Paralogous to G291 |
| 77 | G1216 | DNA | A. thaliana | Predicted polypeptide sequence is paralogous to G2494 |
| 78 | G1216 | PRT | A. thaliana | Paralogous to G2494 |
| 81 | G1228 | DNA | A. thaliana | Predicted polypeptide sequence is paralogous to G1227 |
| 82 | G1228 | PRT | A. thaliana | Paralogous to G1227 |
| 85 | G1233 | DNA | A. thaliana | Predicted polypeptide sequence is paralogous to G1303 |
| 86 | G1233 | PRT | A. thaliana | Paralogous to G1303 |
| 87 | G1240 | DNA | A. thaliana | Predicted polypeptide sequence is paralogous to G1241 |
| 88 | G1240 | PRT | A. thaliana | Paralogous to G1241 |
| 89 | G1243 | DNA | A. thaliana | Predicted polypeptide sequence is paralogous to G1242 |
| 90 | G1243 | PRT | A. thaliana | Paralogous to G1242 |
| 93 | G1247 | DNA | A. thaliana | Predicted polypeptide sequence is paralogous to G1245 |
| 94 | G1247 | PRT | A. thaliana | Paralogous to G1245 |
| 97 | G1256 | DNA | A. thaliana | Predicted polypeptide sequence is paralogous to G2003 |
| 98 | G1256 | PRT | A. thaliana | Paralogous to G2003 |
| 99 | G1266 | DNA | A. thaliana | Predicted polypeptide sequence is orthologous to G5184, G5185, G5186, G5170 |
| 100 | G1266 | PRT | A. thaliana | Orthologous to G5184, G5185, G5186, G5170 |
| 105 | G1274 | DNA | A. thaliana | Predicted polypeptide sequence is paralogous to G1275; orthologous to G3722, G3723, G3724, G3731, G3732, G3803, G3719, G3720, G3721, G3725, G3726, G3727, G3728, G3729, G3730, G3733, G3795, G3797, G3802, G3804 |
| 106 | G1274 | PRT | A. thaliana | Paralogous to G1275; Orthologous to G3722, G3723, G3724, G3731, G3732, G3803, G3719, G3720, G3721, G3725, G3726, G3727, G3728, G3729, G3730, G3733, G3795, G3797, G3802, G3804 |
| 107 | G1275 | DNA | A. thaliana | Predicted polypeptide sequence is paralogous to G1274; orthologous to G3722, G3723, G3724, G3731, G3732, G3803, G3719, G3720, G3721, G3725, G3726, G3727, G3728, G3729, G3730, G3733, G3795, G3797, G3802, G3804 |
| 108 | G1275 | PRT | A. thaliana | Paralogous to G1274; Orthologous to G3722, G3723, G3724, G3731, G3732, G3803, G3719, G3720, G3721, G3725, G3726, G3727, G3728, G3729, G3730, G3733, G3795, G3797, G3802, G3804 |
| 111 | G1293 | DNA | A. thaliana | Predicted polypeptide sequence is paralogous to G2469 |
| 112 | G1293 | PRT | A. thaliana | Paralogous to G2469 |
| 115 | G1303 | DNA | A. thaliana | Predicted polypeptide sequence is paralogous to G1233 |
| 116 | G1303 | PRT | A. thaliana | Paralogous to G1233 |
| 121 | G1309 | DNA | A. thaliana | Predicted polypeptide sequence is paralogous to G237 |
| 122 | G1309 | PRT | A. thaliana | Paralogous to G237 |
| 123 | G1313 | DNA | A. thaliana | Predicted polypeptide sequence is paralogous to G1325 |
| 124 | G1313 | PRT | A. thaliana | Paralogous to G1325 |
| 127 | G1319 | DNA | A. thaliana | Predicted polypeptide sequence is paralogous to G670 |
| 128 | G1319 | PRT | A. thaliana | Paralogous to G670 |
| 129 | G1320 | DNA | A. thaliana | Predicted polypeptide sequence is paralogous to G1321 |
| 130 | G1320 | PRT | A. thaliana | Paralogous to G1321 |
| 131 | G1324 | DNA | A. thaliana | Predicted polypeptide sequence is paralogous to G2893 |
| 132 | G1324 | PRT | A. thaliana | Paralogous to G2893 |
| 135 | G1335 | DNA | A. thaliana | Predicted polypeptide sequence is paralogous to G652 |
| 136 | G1335 | PRT | A. thaliana | Paralogous to G652 |
| 139 | G1349 | DNA | A. thaliana | Predicted polypeptide sequence is paralogous to G1887, G896 |
| 140 | G1349 | PRT | A. thaliana | Paralogous to G1887, G896 |
| 143 | G1354 | DNA | A. thaliana | Predicted polypeptide sequence is paralogous to G1355, G1453, G1766, G2534, G522, G761 |
| 144 | G1354 | PRT | A. thaliana | Paralogous to G1355, G1453, G1766, G2534, G522, G761 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 145 | G1355 | DNA | A. thaliana | Predicted polypeptide sequence is paralogous to G1354, G1453, G1766, G2534, G522, G761 |
| 146 | G1355 | PRT | A. thaliana | Paralogous to G1354, G1453, G1766, G2534, G522, G761 |
| 149 | G1364 | DNA | A. thaliana | Predicted polypeptide sequence is paralogous to G2345, G481, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 150 | G1364 | PRT | A. thaliana | Paralogous to G2345, G481, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 153 | G137 | DNA | A. thaliana | Predicted polypeptide sequence is paralogous to G139, G145 |
| 154 | G137 | PRT | A. thaliana | Paralogous to G139, G145 |
| 155 | G1379 | DNA | A. thaliana | Predicted polypeptide sequence is paralogous to G12, G1277, G24; orthologous to G3656 |
| 156 | G1379 | PRT | A. thaliana | Paralogous to G12, G1277, G24; Orthologous to G3656 |
| 161 | G1384 | DNA | A. thaliana | Predicted polypeptide sequence is paralogous to G1763 |
| 162 | G1384 | PRT | A. thaliana | Paralogous to G1763 |
| 165 | G139 | DNA | A. thaliana | Predicted polypeptide sequence is paralogous to G137, G145 |
| 166 | G139 | PRT | A. thaliana | Paralogous to G137, G145 |
| 167 | G1394 | DNA | A. thaliana | Predicted polypeptide sequence is paralogous to G1395, G1396 |
| 168 | G1394 | PRT | A. thaliana | Paralogous to G1395, G1396 |
| 169 | G1395 | DNA | A. thaliana | Predicted polypeptide sequence is paralogous to G1394, G1396 |
| 170 | G1395 | PRT | A. thaliana | Paralogous to G1394, G1396 |
| 171 | G140 | DNA | A. thaliana | Predicted polypeptide sequence is paralogous to G129, G136, G146 |
| 172 | G140 | PRT | A. thaliana | Paralogous to G129, G136, G146 |
| 177 | G1419 | DNA | A. thaliana | Predicted polypeptide sequence is paralogous to G43, G46, G1004, G29; orthologous to G3849 |
| 178 | G1419 | PRT | A. thaliana | Paralogous to G43, G46, G1004, G29; Orthologous to G3849 |
| 179 | G1421 | DNA | A. thaliana | Predicted polypeptide sequence is paralogous to G1750, G440, G864; orthologous to G4079, G4080, G4283, G4284, G4285, G4286, G4287, G4288, G4289, G4290, G4291, G4292, G4293 |
| 180 | G1421 | PRT | A. thaliana | Paralogous to G1750, G440, G864; Orthologous to G4079, G4080, G4283, G4284, G4285, G4286, G4287, G4288, G4289, G4290, G4291, G4292, G4293 |
| 181 | G1423 | DNA | A. thaliana | Predicted polypeptide sequence is paralogous to G1424, G2988 |
| 182 | G1423 | PRT | A. thaliana | Paralogous to G1424, G2988 |
| 183 | G1435 | DNA | A. thaliana | Predicted polypeptide sequence is paralogous to G2741; orthologous to G4240, G4241, G4243, G4244, G4245 |
| 184 | G1435 | PRT | A. thaliana | Paralogous to G2741; Orthologous to G4240, G4241, G4243, G4244, G4245 |
| 189 | G1439 | DNA | A. thaliana | Predicted polypeptide sequence is paralogous to G1868 |
| 190 | G1439 | PRT | A. thaliana | Paralogous to G1868 |
| 195 | G145 | DNA | A. thaliana | Predicted polypeptide sequence is paralogous to G137, G139 |
| 196 | G145 | PRT | A. thaliana | Paralogous to G137, G139 |
| 197 | G1451 | DNA | A. thaliana | Predicted polypeptide sequence is paralogous to G990 |
| 198 | G1451 | PRT | A. thaliana | Paralogous to G990 |
| 199 | G1456 | DNA | A. thaliana | Predicted polypeptide sequence is paralogous to G1927, G2184 |
| 200 | G1456 | PRT | A. thaliana | Paralogous to G1927, G2184 |
| 201 | G146 | DNA | A. thaliana | Predicted polypeptide sequence is paralogous to G129, G136, G140 |
| 202 | G146 | PRT | A. thaliana | Paralogous to G129, G136, G140 |
| 203 | G1460 | DNA | A. thaliana | Predicted polypeptide sequence is paralogous to G1458, G1459 |
| 204 | G1460 | PRT | A. thaliana | Paralogous to G1458, G1459 |
| 205 | G1462 | DNA | A. thaliana | Predicted polypeptide sequence is paralogous to G1461, G1463, G1464, G1465 |
| 206 | G1462 | PRT | A. thaliana | Paralogous to G1461, G1463, G1464, G1465 |
| 213 | G1478 | DNA | A. thaliana | Predicted polypeptide sequence is paralogous to G1929; orthologous to G4019 |
| 214 | G1478 | PRT | A. thaliana | Paralogous to G1929; Orthologous to G4019 |
| 215 | G148 | DNA | A. thaliana | Predicted polypeptide sequence is paralogous to G142 |
| 216 | G148 | PRT | A. thaliana | Paralogous to G142 |
| 217 | G1480 | DNA | A. thaliana | Predicted polypeptide sequence is paralogous to G897, G899 |
| 218 | G1480 | PRT | A. thaliana | Paralogous to G897, G899 |
| 219 | G1487 | DNA | A. thaliana | Predicted polypeptide sequence is paralogous to G1505 |
| 220 | G1487 | PRT | A. thaliana | Paralogous to G1505 |
| 221 | G1488 | DNA | A. thaliana | Predicted polypeptide sequence is paralogous to G1489 |
| 222 | G1488 | PRT | A. thaliana | Paralogous to G1489 |
| 223 | G1491 | DNA | A. thaliana | Predicted polypeptide sequence is paralogous to G2128 |
| 224 | G1491 | PRT | A. thaliana | Paralogous to G2128 |
| 225 | G1494 | DNA | A. thaliana | Predicted polypeptide sequence is paralogous to G789 |
| 226 | G1494 | PRT | A. thaliana | Paralogous to G789 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 231 | G1505 | DNA | A. thaliana | Predicted polypeptide sequence is paralogous to G1487 |
| 232 | G1505 | PRT | A. thaliana | Paralogous to G1487 |
| 233 | G1506 | DNA | A. thaliana | Predicted polypeptide sequence is paralogous to G1509 |
| 234 | G1506 | PRT | A. thaliana | Paralogous to G1509 |
| 235 | G1510 | DNA | A. thaliana | Predicted polypeptide sequence is paralogous to G1779 |
| 236 | G1510 | PRT | A. thaliana | Paralogous to G1779 |
| 239 | G1518 | DNA | A. thaliana | Predicted polypeptide sequence is orthologous to G4628, G4629, G4633, G4635 |
| 240 | G1518 | PRT | A. thaliana | Orthologous to G4628, G4629, G4633, G4635 |
| 249 | G1535 | DNA | A. thaliana | Predicted polypeptide sequence is paralogous to G389 |
| 250 | G1535 | PRT | A. thaliana | Paralogous to G389 |
| 251 | G1538 | DNA | A. thaliana | Predicted polypeptide sequence is paralogous to G1545, G412 |
| 252 | G1538 | PRT | A. thaliana | Paralogous to G1545, G412 |
| 253 | G154 | DNA | A. thaliana | Predicted polypeptide sequence is paralogous to G149, G627, G1011, G1797, G1798; orthologous to G4061, G4062, G4063, G4064, G4065, G4066, G4067 |
| 254 | G154 | PRT | A. thaliana | Paralogous to G149, G627, G1011, G1797, G1798; Orthologous to G4061, G4062, G4063, G4064, G4065, G4066, G4067 |
| 257 | G1543 | DNA | A. thaliana | Predicted polypeptide sequence is orthologous to G3510, G3490, G3524, G4369, G4370, G4371 |
| 258 | G1543 | PRT | A. thaliana | Orthologous to G3510, G3490, G3524, G4369, G4370, G4371 |
| 261 | G1550 | DNA | A. thaliana | Predicted polypeptide sequence is paralogous to G1592 |
| 262 | G1550 | PRT | A. thaliana | Paralogous to G1592 |
| 265 | G1553 | DNA | A. thaliana | Predicted polypeptide sequence is paralogous to G472, G716 |
| 266 | G1553 | PRT | A. thaliana | Paralogous to G472, G716 |
| 267 | G1559 | DNA | A. thaliana | Predicted polypeptide sequence is paralogous to G632 |
| 268 | G1559 | PRT | A. thaliana | Paralogous to G632 |
| 271 | G157 | DNA | A. thaliana | Predicted polypeptide sequence is paralogous to G1759, G1842, G1843, G1844, G859 |
| 272 | G157 | PRT | A. thaliana | Paralogous to G1759, G1842, G1843, G1844, G859 |
| 273 | G159 | DNA | A. thaliana | Predicted polypeptide sequence is paralogous to G165 |
| 274 | G159 | PRT | A. thaliana | Paralogous to G165 |
| 275 | G1592 | DNA | A. thaliana | Predicted polypeptide sequence is paralogous to G1550 |
| 276 | G1592 | PRT | A. thaliana | Paralogous to G1550 |
| 277 | G1634 | DNA | A. thaliana | Predicted polypeptide sequence is paralogous to G1638, G2452, G1641, G2701 |
| 278 | G1634 | PRT | A. thaliana | Paralogous to G1638, G2452, G1641, G2701 |
| 283 | G1638 | DNA | A. thaliana | Predicted polypeptide sequence is paralogous to G2452, G1641, G1634, G2701 |
| 284 | G1638 | PRT | A. thaliana | Paralogous to G2452, G1641, G1634, G2701 |
| 289 | G1646 | DNA | A. thaliana | Predicted polypeptide sequence is paralogous to G715; orthologous to G3883, G3884, G3885, G3886, G3889, G3543, G4259 |
| 290 | G1646 | PRT | A. thaliana | Paralogous to G715; Orthologous to G3883, G3884, G3885, G3886, G3889, G3543, G4259 |
| 291 | G165 | DNA | A. thaliana | Predicted polypeptide sequence is paralogous to G159 |
| 292 | G165 | PRT | A. thaliana | Paralogous to G159 |
| 299 | G166 | DNA | A. thaliana | Predicted polypeptide sequence is paralogous to G164 |
| 300 | G166 | PRT | A. thaliana | Paralogous to G164 |
| 313 | G168 | DNA | A. thaliana | Predicted polypeptide sequence is paralogous to G170, G2065 |
| 314 | G168 | PRT | A. thaliana | Paralogous to G170, G2065 |
| 319 | G1750 | DNA | A. thaliana | Predicted polypeptide sequence is paralogous to G1421, G440, G864; orthologous to G4079, G4080, G4283, G4284, G4285, G4286, G4287, G4288, G4289, G4290, G4291, G4292, G4293 |
| 320 | G1750 | PRT | A. thaliana | Paralogous to G1421, G440, G864; Orthologous to G4079, G4080, G4283, G4284, G4285, G4286, G4287, G4288, G4289, G4290, G4291, G4292, G4293 |
| 323 | G1752 | DNA | A. thaliana | Predicted polypeptide sequence is paralogous to G2512 |
| 324 | G1752 | PRT | A. thaliana | Paralogous to G2512 |
| 325 | G1755 | DNA | A. thaliana | Predicted polypeptide sequence is paralogous to G1754 |
| 326 | G1755 | PRT | A. thaliana | Paralogous to G1754 |
| 327 | G1757 | DNA | A. thaliana | Predicted polypeptide sequence is paralogous to G1847 |
| 328 | G1757 | PRT | A. thaliana | Paralogous to G1847 |
| 331 | G1759 | DNA | A. thaliana | Predicted polypeptide sequence is paralogous to G157, G1842, G1843, G1844, G859 |
| 332 | G1759 | PRT | A. thaliana | Paralogous to G157, G1842, G1843, G1844, G859 |
| 333 | G1760 | DNA | A. thaliana | Predicted polypeptide sequence is paralogous to G152, G153, G860; orthologous to G3479, G3480, G3481, G3482, G3483, G3484, G3485, G3487, G3488, G3489, G3980, G3981, G3982 |
| 334 | G1760 | PRT | A. thaliana | Paralogous to G152, G153, G860; Orthologous to G3479, G3480, G3481, G3482, G3483, G3484, G3485, G3487, G3488, G3489, G3980, G3981, G3982 |
| 335 | G1763 | DNA | A. thaliana | Predicted polypeptide sequence is paralogous to G1384 |
| 336 | G1763 | PRT | A. thaliana | Paralogous to G1384 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 353 | G1789 | DNA | A. thaliana | Predicted polypeptide sequence is paralogous to G1911, G2721, G997 |
| 354 | G1789 | PRT | A. thaliana | Paralogous to G1911, G2721, G997 |
| 357 | G1797 | DNA | A. thaliana | Predicted polypeptide sequence is paralogous to G149, G627, G1011, G154, G1798; orthologous to G4061, G4062, G4063, G4064, G4065, G4066, G4067 |
| 358 | G1797 | PRT | A. thaliana | Paralogous to G149, G627, G1011, G154, G1798; Orthologous to G4061, G4062, G4063, G4064, G4065, G4066, G4067 |
| 363 | G1806 | DNA | A. thaliana | Predicted polypeptide sequence is paralogous to G1198, G554, G555, G556, G558, G578, G629 |
| 364 | G1806 | PRT | A. thaliana | Paralogous to G1198, G554, G555, G556, G558, G578, G629 |
| 365 | G1807 | DNA | A. thaliana | Predicted polypeptide sequence is paralogous to G1050 |
| 366 | G1807 | PRT | A. thaliana | Paralogous to G1050 |
| 367 | G1808 | DNA | A. thaliana | Predicted polypeptide sequence is paralogous to G1047 |
| 368 | G1808 | PRT | A. thaliana | Paralogous to G1047 |
| 369 | G1809 | DNA | A. thaliana | Predicted polypeptide sequence is paralogous to G557; orthologous to G4627, G4630, G4631, G4632, G5158 |
| 370 | G1809 | PRT | A. thaliana | Paralogous to G557; Orthologous to G4627, G4630, G4631, G4632, G5158 |
| 377 | G1821 | DNA | A. thaliana | Predicted polypeptide sequence is paralogous to G620; orthologous to G3839, G3937, G3939 |
| 378 | G1821 | PRT | A. thaliana | Paralogous to G620; Orthologous to G3839, G3937, G3939 |
| 381 | G1836 | DNA | A. thaliana | Predicted polypeptide sequence is paralogous to G1818 |
| 382 | G1836 | PRT | A. thaliana | Paralogous to G1818 |
| 383 | G1838 | DNA | A. thaliana | Predicted polypeptide sequence is paralogous to G2572 |
| 384 | G1838 | PRT | A. thaliana | Paralogous to G2572 |
| 385 | G1839 | DNA | A. thaliana | Predicted polypeptide sequence is paralogous to G1749, G1840 |
| 386 | G1839 | PRT | A. thaliana | Paralogous to G1749, G1840 |
| 387 | G1842 | DNA | A. thaliana | Predicted polypeptide sequence is paralogous to G157, G1759, G1843, G1844, G859 |
| 388 | G1842 | PRT | A. thaliana | Paralogous to G157, G1759, G1843, G1844, G859 |
| 389 | G1843 | DNA | A. thaliana | Predicted polypeptide sequence is paralogous to G157, G1759, G1842, G1844, G859 |
| 390 | G1843 | PRT | A. thaliana | Paralogous to G157, G1759, G1842, G1844, G859 |
| 391 | G1844 | DNA | A. thaliana | Predicted polypeptide sequence is paralogous to G157, G1759, G1842, G1843, G859 |
| 392 | G1844 | PRT | A. thaliana | Paralogous to G157, G1759, G1842, G1843, G859 |
| 393 | G1847 | DNA | A. thaliana | Predicted polypeptide sequence is paralogous to G1757 |
| 394 | G1847 | PRT | A. thaliana | Paralogous to G1757 |
| 395 | G1850 | DNA | A. thaliana | Predicted polypeptide sequence is paralogous to G1181 |
| 396 | G1850 | PRT | A. thaliana | Paralogous to G1181 |
| 397 | G1855 | DNA | A. thaliana | Predicted polypeptide sequence is paralogous to G1186 |
| 398 | G1855 | PRT | A. thaliana | Paralogous to G1186 |
| 399 | G1863 | DNA | A. thaliana | Predicted polypeptide sequence is paralogous to G2334 |
| 400 | G1863 | PRT | A. thaliana | Paralogous to G2334 |
| 403 | G1881 | DNA | A. thaliana | Predicted polypeptide sequence is paralogous to G902 |
| 404 | G1881 | PRT | A. thaliana | Paralogous to G902 |
| 407 | G1888 | DNA | A. thaliana | Predicted polypeptide sequence is paralogous to G1482; orthologous to G5159 |
| 408 | G1888 | PRT | A. thaliana | Paralogous to G1482; Orthologous to G5159 |
| 415 | G19 | DNA | A. thaliana | Predicted polypeptide sequence is orthologous to G3851 |
| 416 | G19 | PRT | A. thaliana | Orthologous to G3851 |
| 419 | G1901 | DNA | A. thaliana | Predicted polypeptide sequence is paralogous to G1902 |
| 420 | G1901 | PRT | A. thaliana | Paralogous to G1902 |
| 421 | G1903 | DNA | A. thaliana | Predicted polypeptide sequence is paralogous to G1895 |
| 422 | G1903 | PRT | A. thaliana | Paralogous to G1895 |
| 425 | G1917 | DNA | A. thaliana | Predicted polypeptide sequence is paralogous to G383 |
| 426 | G1917 | PRT | A. thaliana | Paralogous to G383 |
| 439 | G1944 | DNA | A. thaliana | Predicted polypeptide sequence is paralogous to G605 |
| 440 | G1944 | PRT | A. thaliana | Paralogous to G605 |
| 447 | G1959 | DNA | A. thaliana | Predicted polypeptide sequence is paralogous to G1197 |
| 448 | G1959 | PRT | A. thaliana | Paralogous to G1197 |
| 449 | G1965 | DNA | A. thaliana | Predicted polypeptide sequence is paralogous to G1891 |
| 450 | G1965 | PRT | A. thaliana | Paralogous to G1891 |
| 457 | G1987 | DNA | A. thaliana | Predicted polypeptide sequence is paralogous to G1986 |
| 458 | G1987 | PRT | A. thaliana | Paralogous to G1986 |
| 461 | G1991 | DNA | A. thaliana | Predicted polypeptide sequence is paralogous to G2888 |
| 462 | G1991 | PRT | A. thaliana | Paralogous to G2888 |
| 463 | G2 | DNA | A. thaliana | Predicted polypeptide sequence is paralogous to G1416 |
| 464 | G2 | PRT | A. thaliana | Paralogous to G1416 |
| 469 | G2006 | DNA | A. thaliana | Predicted polypeptide sequence is paralogous to G208 |
| 470 | G2006 | PRT | A. thaliana | Paralogous to G208 |
| 471 | G2007 | DNA | A. thaliana | Predicted polypeptide sequence is paralogous to G231 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 472 | G2007 | PRT | A. thaliana | Paralogous to G231 |
| 475 | G2015 | DNA | A. thaliana | Predicted polypeptide sequence is paralogous to G2016, G2017 |
| 476 | G2015 | PRT | A. thaliana | Paralogous to G2016, G2017 |
| 477 | G2018 | DNA | A. thaliana | Predicted polypeptide sequence is paralogous to G2022 |
| 478 | G2018 | PRT | A. thaliana | Paralogous to G2022 |
| 479 | G2020 | DNA | A. thaliana | Predicted polypeptide sequence is paralogous to G2023, G2025 |
| 480 | G2020 | PRT | A. thaliana | Paralogous to G2023, G2025 |
| 481 | G204 | DNA | A. thaliana | Predicted polypeptide sequence is paralogous to G2717, G2709 |
| 482 | G204 | PRT | A. thaliana | Paralogous to G2717, G2709 |
| 483 | G2053 | DNA | A. thaliana | Predicted polypeptide sequence is paralogous to G515, G516, G517 |
| 484 | G2053 | PRT | A. thaliana | Paralogous to G515, G516, G517 |
| 485 | G2057 | DNA | A. thaliana | Predicted polypeptide sequence is paralogous to G618 |
| 486 | G2057 | PRT | A. thaliana | Paralogous to G618 |
| 489 | G206 | DNA | A. thaliana | Predicted polypeptide sequence is paralogous to G1307 |
| 490 | G206 | PRT | A. thaliana | Paralogous to G1307 |
| 493 | G2062 | DNA | A. thaliana | Predicted polypeptide sequence is paralogous to G2063, G2297, G2689 |
| 494 | G2062 | PRT | A. thaliana | Paralogous to G2063, G2297, G2689 |
| 495 | G2063 | DNA | A. thaliana | Predicted polypeptide sequence is paralogous to G2062, G2297, G2689 |
| 496 | G2063 | PRT | A. thaliana | Paralogous to G2062, G2297, G2689 |
| 499 | G2071 | DNA | A. thaliana | Predicted polypeptide sequence is paralogous to G1058 |
| 500 | G2071 | PRT | A. thaliana | Paralogous to G1058 |
| 513 | G2094 | DNA | A. thaliana | Predicted polypeptide sequence is paralogous to G1508 |
| 514 | G2094 | PRT | A. thaliana | Paralogous to G1508 |
| 515 | G21 | DNA | A. thaliana | Predicted polypeptide sequence is paralogous to G1381 |
| 516 | G21 | PRT | A. thaliana | Paralogous to G1381 |
| 517 | G210 | DNA | A. thaliana | Predicted polypeptide sequence is paralogous to G2426 |
| 518 | G210 | PRT | A. thaliana | Paralogous to G2426 |
| 521 | G2107 | DNA | A. thaliana | Predicted polypeptide sequence is paralogous to G40, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 522 | G2107 | PRT | A. thaliana | Paralogous to G40, G2513, G41, G42, G912; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 537 | G2130 | DNA | A. thaliana | Predicted polypeptide sequence is paralogous to G1008 |
| 538 | G2130 | PRT | A. thaliana | Paralogous to G1008 |
| 547 | G2144 | DNA | A. thaliana | Predicted polypeptide sequence is paralogous to G1942 |
| 548 | G2144 | PRT | A. thaliana | Paralogous to G1942 |
| 549 | G2145 | DNA | A. thaliana | Predicted polypeptide sequence is paralogous to G2148 |
| 550 | G2145 | PRT | A. thaliana | Paralogous to G2148 |
| 553 | G2148 | DNA | A. thaliana | Predicted polypeptide sequence is paralogous to G2145 |
| 554 | G2148 | PRT | A. thaliana | Paralogous to G2145 |
| 559 | G2156 | DNA | A. thaliana | Predicted polypeptide sequence is paralogous to G1067, G1073; orthologous to G3399, G3400 |
| 560 | G2156 | PRT | A. thaliana | Paralogous to G1067, G1073; Orthologous to G3399, G3400 |
| 561 | G2157 | DNA | A. thaliana | Predicted polypeptide sequence is orthologous to G4570 |
| 562 | G2157 | PRT | A. thaliana | Orthologous to G4570 |
| 563 | G216 | DNA | A. thaliana | Predicted polypeptide sequence is paralogous to G2719 |
| 564 | G216 | PRT | A. thaliana | Paralogous to G2719 |
| 569 | G22 | DNA | A. thaliana | Predicted polypeptide sequence is paralogous to G1006, G28; orthologous to G3430, G3659, G3660, G3661, G3717, G3718, G3841, G3843, G3844, G3845, G3846, G3848, G3852, G3856, G3857, G3858, G3864, G3865, G4626, G5171 |
| 570 | G22 | PRT | A. thaliana | Paralogous to G1006, G28; Orthologous to G3430, G3659, G3660, G3661, G3717, G3718, G3841, G3843, G3844, G3845, G3846, G3848, G3852, G3856, G3857, G3858, G3864, G3865, G4626, G5171 |
| 573 | G2215 | DNA | A. thaliana | Predicted polypeptide sequence is paralogous to G2216 |
| 574 | G2215 | PRT | A. thaliana | Paralogous to G2216 |
| 587 | G225 | DNA | A. thaliana | Predicted polypeptide sequence is paralogous to G1816, G226, G2718, G682, G3930; orthologous to G3392, G3393, G3431, G3444, G3445, G3446, G3447, G3448, G3449, G3450 |
| 588 | G225 | PRT | A. thaliana | Paralogous to G1816, G226, G2718, G682, G3930; Orthologous to G3392, G3393, G3431, G3444, G3445, G3446, G3447, G3448, G3449, G3450 |
| 595 | G227 | DNA | A. thaliana | Predicted polypeptide sequence is paralogous to G207, G230, G242; orthologous to G4218, G4219, G4220, G4221, G4222, G4223, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G4224, G4225, G4226, G4227, G4228, G4229, G4230, G4231, G4232, G4234, G4235, G4236, G4237, G4238 |
| 596 | G227 | PRT | *A. thaliana* | Paralogous to G207, G230, G242; Orthologous to G4218, G4219, G4220, G4221, G4222, G4223, G4224, G4225, G4226, G4227, G4228, G4229, G4230, G4231, G4232, G4234, G4235, G4236, G4237, G4238 |
| 597 | G229 | DNA | *A. thaliana* | Predicted polypeptide sequence is paralogous to G678 |
| 598 | G229 | PRT | *A. thaliana* | Paralogous to G678 |
| 609 | G2299 | DNA | *A. thaliana* | Predicted polypeptide sequence is paralogous to G16 |
| 610 | G2299 | PRT | *A. thaliana* | Paralogous to G16 |
| 617 | G2316 | DNA | *A. thaliana* | Predicted polypeptide sequence is paralogous to G1817 |
| 618 | G2316 | PRT | *A. thaliana* | Paralogous to G1817 |
| 621 | G232 | DNA | *A. thaliana* | Predicted polypeptide sequence is paralogous to G234 |
| 622 | G232 | PRT | *A. thaliana* | Paralogous to G234 |
| 623 | G2334 | DNA | *A. thaliana* | Predicted polypeptide sequence is paralogous to G1863 |
| 624 | G2334 | PRT | *A. thaliana* | Paralogous to G1863 |
| 625 | G2342 | DNA | *A. thaliana* | Predicted polypeptide sequence is paralogous to G2427 |
| 626 | G2342 | PRT | *A. thaliana* | Paralogous to G2427 |
| 629 | G2344 | DNA | *A. thaliana* | Predicted polypeptide sequence is paralogous to G929; orthologous to G4267, G4268 |
| 630 | G2344 | PRT | *A. thaliana* | Paralogous to G929; Orthologous to G4267, G4268 |
| 631 | G236 | DNA | *A. thaliana* | Predicted polypeptide sequence is paralogous to G2715 |
| 632 | G236 | PRT | *A. thaliana* | Paralogous to G2715 |
| 633 | G237 | DNA | *A. thaliana* | Predicted polypeptide sequence is paralogous to G1309 |
| 634 | G237 | PRT | *A. thaliana* | Paralogous to G1309 |
| 635 | G2371 | DNA | *A. thaliana* | Predicted polypeptide sequence is paralogous to G925 |
| 636 | G2371 | PRT | *A. thaliana* | Paralogous to G925 |
| 641 | G2377 | DNA | *A. thaliana* | Predicted polypeptide sequence is paralogous to G2379 |
| 642 | G2377 | PRT | *A. thaliana* | Paralogous to G2379 |
| 645 | G2394 | DNA | *A. thaliana* | Predicted polypeptide sequence is paralogous to G1108 |
| 646 | G2394 | PRT | *A. thaliana* | Paralogous to G1108 |
| 649 | G241 | DNA | *A. thaliana* | Predicted polypeptide sequence is paralogous to G233; orthologous to G4306, G4307, G4308, G4309, G4310 |
| 650 | G241 | PRT | *A. thaliana* | Paralogous to G233; Orthologous to G4306, G4307, G4308, G4309, G4310 |
| 653 | G242 | DNA | *A. thaliana* | Predicted polypeptide sequence is paralogous to G207, G227, G230; orthologous to G4218, G4219, G4220, G4221, G4222, G4223, G4224, G4225, G4226, G4227, G4228, G4229, G4230, G4231, G4232, G4234, G4235, G4236, G4237, G4238 |
| 654 | G242 | PRT | *A. thaliana* | Paralogous to G207, G227, G230; Orthologous to G4218, G4219, G4220, G4221, G4222, G4223, G4224, G4225, G4226, G4227, G4228, G4229, G4230, G4231, G4232, G4234, G4235, G4236, G4237, G4238 |
| 655 | G2421 | DNA | *A. thaliana* | Predicted polypeptide sequence is paralogous to G1329, G2422, G663 |
| 656 | G2421 | PRT | *A. thaliana* | Paralogous to G1329, G2422, G663 |
| 657 | G2422 | DNA | *A. thaliana* | Predicted polypeptide sequence is paralogous to G1329, G2421, G663 |
| 658 | G2422 | PRT | *A. thaliana* | Paralogous to G1329, G2421, G663 |
| 661 | G2426 | DNA | *A. thaliana* | Predicted polypeptide sequence is paralogous to G210 |
| 662 | G2426 | PRT | *A. thaliana* | Paralogous to G210 |
| 663 | G2427 | DNA | *A. thaliana* | Predicted polypeptide sequence is paralogous to G2342 |
| 664 | G2427 | PRT | *A. thaliana* | Paralogous to G2342 |
| 665 | G243 | DNA | *A. thaliana* | Predicted polypeptide sequence is paralogous to G201, G202 |
| 666 | G243 | PRT | *A. thaliana* | Paralogous to G201, G202 |
| 667 | G2437 | DNA | *A. thaliana* | Predicted polypeptide sequence is paralogous to G1507 |
| 668 | G2437 | PRT | *A. thaliana* | Paralogous to G1507 |
| 671 | G2452 | DNA | *A. thaliana* | Predicted polypeptide sequence is paralogous to G1638, G1641, G1634, G2701 |
| 672 | G2452 | PRT | *A. thaliana* | Paralogous to G1638, G1641, G1634, G2701 |
| 673 | G2454 | DNA | *A. thaliana* | Predicted polypeptide sequence is paralogous to G2456 |
| 674 | G2454 | PRT | *A. thaliana* | Paralogous to G2456 |
| 675 | G2457 | DNA | *A. thaliana* | Predicted polypeptide sequence is paralogous to G2459 |
| 676 | G2457 | PRT | *A. thaliana* | Paralogous to G2459 |
| 681 | G2484 | DNA | *A. thaliana* | Predicted polypeptide sequence is paralogous to G1232 |
| 682 | G2484 | PRT | *A. thaliana* | Paralogous to G1232 |
| 685 | G2505 | DNA | *A. thaliana* | Predicted polypeptide sequence is paralogous to G2635 |
| 686 | G2505 | PRT | *A. thaliana* | Paralogous to G2635 |
| 691 | G2535 | DNA | *A. thaliana* | Predicted polypeptide sequence is paralogous to G957, G961 |
| 692 | G2535 | PRT | *A. thaliana* | Paralogous to G957, G961 |
| 693 | G2546 | DNA | *A. thaliana* | Predicted polypeptide sequence is paralogous to G2550 |
| 694 | G2546 | PRT | *A. thaliana* | Paralogous to G2550 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 695 | G255 | DNA | A. thaliana | Predicted polypeptide sequence is paralogous to G197, G664; orthologous to G3503, G3504, G3505, G3506, G3507, G3508, G3509, G3529, G3531, G3532, G3533, G3534, G3527, G3528, G4637, G4638, G4639, G4640 |
| 696 | G255 | PRT | A. thaliana | Paralogous to G197, G664; Orthologous to G3503, G3504, G3505, G3506, G3507, G3508, G3509, G3529, G3531, G3532, G3533, G3534, G3527, G3528, G4637, G4638, G4639, G4640 |
| 697 | G2550 | DNA | A. thaliana | Predicted polypeptide sequence is paralogous to G2546 |
| 698 | G2550 | PRT | A. thaliana | Paralogous to G2546 |
| 701 | G2553 | DNA | A. thaliana | Predicted polypeptide sequence is paralogous to G2556 |
| 702 | G2553 | PRT | A. thaliana | Paralogous to G2556 |
| 705 | G2555 | DNA | A. thaliana | Predicted polypeptide sequence is paralogous to G1134 |
| 706 | G2555 | PRT | A. thaliana | Paralogous to G1134 |
| 707 | G2556 | DNA | A. thaliana | Predicted polypeptide sequence is paralogous to G2553 |
| 708 | G2556 | PRT | A. thaliana | Paralogous to G2553 |
| 711 | G2574 | DNA | A. thaliana | Predicted polypeptide sequence is paralogous to G2110 |
| 712 | G2574 | PRT | A. thaliana | Paralogous to G2110 |
| 723 | G2586 | DNA | A. thaliana | Predicted polypeptide sequence is paralogous to G2587, G2686 |
| 724 | G2586 | PRT | A. thaliana | Paralogous to G2587, G2686 |
| 733 | G261 | DNA | A. thaliana | Predicted polypeptide sequence is paralogous to G265 |
| 734 | G261 | PRT | A. thaliana | Paralogous to G265 |
| 735 | G2616 | DNA | A. thaliana | Predicted polypeptide sequence is paralogous to G2809 |
| 736 | G2616 | PRT | A. thaliana | Paralogous to G2809 |
| 741 | G2632 | DNA | A. thaliana | Predicted polypeptide sequence is paralogous to G926; orthologous to G3924, G4261 |
| 742 | G2632 | PRT | A. thaliana | Paralogous to G926; Orthologous to G3924, G4261 |
| 743 | G2639 | DNA | A. thaliana | Predicted polypeptide sequence is paralogous to G2640, G2642 |
| 744 | G2639 | PRT | A. thaliana | Paralogous to G2640, G2642 |
| 747 | G2640 | DNA | A. thaliana | Predicted polypeptide sequence is paralogous to G2639, G2642 |
| 748 | G2640 | PRT | A. thaliana | Paralogous to G2639, G2642 |
| 749 | G265 | DNA | A. thaliana | Predicted polypeptide sequence is paralogous to G261 |
| 750 | G265 | PRT | A. thaliana | Paralogous to G261 |
| 751 | G2650 | DNA | A. thaliana | Predicted polypeptide sequence is paralogous to G617 |
| 752 | G2650 | PRT | A. thaliana | Paralogous to G617 |
| 753 | G2655 | DNA | A. thaliana | Predicted polypeptide sequence is paralogous to G1879 |
| 754 | G2655 | PRT | A. thaliana | Paralogous to G1879 |
| 761 | G268 | DNA | A. thaliana | Predicted polypeptide sequence is paralogous to G2876, G820 |
| 762 | G268 | PRT | A. thaliana | Paralogous to G2876, G820 |
| 765 | G2686 | DNA | A. thaliana | Predicted polypeptide sequence is paralogous to G2586, G2587 |
| 766 | G2686 | PRT | A. thaliana | Paralogous to G2586, G2587 |
| 769 | G2696 | DNA | A. thaliana | Predicted polypeptide sequence is paralogous to G2698 |
| 770 | G2696 | PRT | A. thaliana | Paralogous to G2698 |
| 771 | G2697 | DNA | A. thaliana | Predicted polypeptide sequence is paralogous to G1768, G2633, G313, G852; orthologous to G3815, G3825 |
| 772 | G2697 | PRT | A. thaliana | Paralogous to G1768, G2633, G313, G852; Orthologous to G3815, G3825 |
| 773 | G2699 | DNA | A. thaliana | Predicted polypeptide sequence is paralogous to G314 |
| 774 | G2699 | PRT | A. thaliana | Paralogous to G314 |
| 781 | G2715 | DNA | A. thaliana | Predicted polypeptide sequence is paralogous to G236 |
| 782 | G2715 | PRT | A. thaliana | Paralogous to G236 |
| 783 | G2719 | DNA | A. thaliana | Predicted polypeptide sequence is paralogous to G216 |
| 784 | G2719 | PRT | A. thaliana | Paralogous to G216 |
| 787 | G2721 | DNA | A. thaliana | Predicted polypeptide sequence is paralogous to G1789, G1911, G997 |
| 788 | G2721 | PRT | A. thaliana | Paralogous to G1789, G1911, G997 |
| 793 | G273 | DNA | A. thaliana | Predicted polypeptide sequence is paralogous to G819 |
| 794 | G273 | PRT | A. thaliana | Paralogous to G819 |
| 795 | G2739 | DNA | A. thaliana | Predicted polypeptide sequence is paralogous to G312 |
| 796 | G2739 | PRT | A. thaliana | Paralogous to G312 |
| 797 | G274 | DNA | A. thaliana | Predicted polypeptide sequence is paralogous to G833 |
| 798 | G274 | PRT | A. thaliana | Paralogous to G833 |
| 799 | G2742 | DNA | A. thaliana | Predicted polypeptide sequence is paralogous to G1492 |
| 800 | G2742 | PRT | A. thaliana | Paralogous to G1492 |
| 801 | G2747 | DNA | A. thaliana | Predicted polypeptide sequence is paralogous to G1010 |
| 802 | G2747 | PRT | A. thaliana | Paralogous to G1010 |
| 809 | G2766 | DNA | A. thaliana | Predicted polypeptide sequence is paralogous to G2149; orthologous to G3763, G3764, G3740, G3741, G3772 |
| 810 | G2766 | PRT | A. thaliana | Paralogous to G2149; Orthologous to G3763, G3764, G3740, G3741, G3772 |
| 815 | G2779 | DNA | A. thaliana | Predicted polypeptide sequence is paralogous to G2859 |
| 816 | G2779 | PRT | A. thaliana | Paralogous to G2859 |
| 817 | G2789 | DNA | A. thaliana | Predicted polypeptide sequence is paralogous to G596; orthologous to G3457 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 818 | G2789 | PRT | A. thaliana | Paralogous to G596; Orthologous to G3457 |
| 819 | G279 | DNA | A. thaliana | Predicted polypeptide sequence is paralogous to G1029, G1033 |
| 820 | G279 | PRT | A. thaliana | Paralogous to G1029, G1033 |
| 823 | G2791 | DNA | A. thaliana | Predicted polypeptide sequence is paralogous to G589, G1061; orthologous to G3748, G3749, G3774, G3760 |
| 824 | G2791 | PRT | A. thaliana | Paralogous to G589, G1061; Orthologous to G3748, G3749, G3774, G3760 |
| 827 | G28 | DNA | A. thaliana | Predicted polypeptide sequence is paralogous to G22, G1006; orthologous to G3430, G3659, G3660, G3661, G3717, G3718, G3841, G3843, G3844, G3845, G3846, G3848, G3852, G3856, G3857, G3858, G3864, G3865, G4626, G5171 |
| 828 | G28 | PRT | A. thaliana | Paralogous to G22, G1006; Orthologous to G3430, G3659, G3660, G3661, G3717, G3718, G3841, G3843, G3844, G3845, G3846, G3848, G3852, G3856, G3857, G3858, G3864, G3865, G4626, G5171 |
| 833 | G2802 | DNA | A. thaliana | Predicted polypeptide sequence is paralogous to G1672 |
| 834 | G2802 | PRT | A. thaliana | Paralogous to G1672 |
| 839 | G2809 | DNA | A. thaliana | Predicted polypeptide sequence is paralogous to G2616 |
| 840 | G2809 | PRT | A. thaliana | Paralogous to G2616 |
| 841 | G2818 | DNA | A. thaliana | Predicted polypeptide sequence is paralogous to G2817 |
| 842 | G2818 | PRT | A. thaliana | Paralogous to G2817 |
| 843 | G2826 | DNA | A. thaliana | Predicted polypeptide sequence is paralogous to G1995, G2838, G361, G362, G370 |
| 844 | G2826 | PRT | A. thaliana | Paralogous to G1995, G2838, G361, G362, G370 |
| 845 | G2831 | DNA | A. thaliana | Predicted polypeptide sequence is paralogous to G903 |
| 846 | G2831 | PRT | A. thaliana | Paralogous to G903 |
| 851 | G2838 | DNA | A. thaliana | Predicted polypeptide sequence is paralogous to G1995, G2826, G361, G362, G370 |
| 852 | G2838 | PRT | A. thaliana | Paralogous to G1995, G2826, G361, G362, G370 |
| 853 | G2840 | DNA | A. thaliana | Predicted polypeptide sequence is paralogous to G2834 |
| 854 | G2840 | PRT | A. thaliana | Paralogous to G2834 |
| 861 | G2855 | DNA | A. thaliana | Predicted polypeptide sequence is paralogous to G2158 |
| 862 | G2855 | PRT | A. thaliana | Paralogous to G2158 |
| 867 | G2876 | DNA | A. thaliana | Predicted polypeptide sequence is paralogous to G268, G820 |
| 868 | G2876 | PRT | A. thaliana | Paralogous to G268, G820 |
| 873 | G2887 | DNA | A. thaliana | Predicted polypeptide sequence is paralogous to G521 |
| 874 | G2887 | PRT | A. thaliana | Paralogous to G521 |
| 877 | G2893 | DNA | A. thaliana | Predicted polypeptide sequence is paralogous to G1324 |
| 878 | G2893 | PRT | A. thaliana | Paralogous to G1324 |
| 879 | G2896 | DNA | A. thaliana | Predicted polypeptide sequence is paralogous to G2895 |
| 880 | G2896 | PRT | A. thaliana | Paralogous to G2895 |
| 883 | G29 | DNA | A. thaliana | Predicted polypeptide sequence is paralogous to G1419, G43, G46, G1004; orthologous to G3849 |
| 884 | G29 | PRT | A. thaliana | Paralogous to G1419, G43, G46, G1004; Orthologous to G3849 |
| 885 | G290 | DNA | A. thaliana | Predicted polypeptide sequence is paralogous to G289 |
| 886 | G290 | PRT | A. thaliana | Paralogous to G289 |
| 887 | G2902 | DNA | A. thaliana | Predicted polypeptide sequence is paralogous to G2903 |
| 888 | G2902 | PRT | A. thaliana | Paralogous to G2903 |
| 911 | G2965 | DNA | A. thaliana | Predicted polypeptide sequence is paralogous to G3065 |
| 912 | G2965 | PRT | A. thaliana | Paralogous to G3065 |
| 913 | G2966 | DNA | A. thaliana | Predicted polypeptide sequence is paralogous to G3067 |
| 914 | G2966 | PRT | A. thaliana | Paralogous to G3067 |
| 917 | G2979 | DNA | A. thaliana | Predicted polypeptide sequence is paralogous to G2980 |
| 918 | G2979 | PRT | A. thaliana | Paralogous to G2980 |
| 919 | G2980 | DNA | A. thaliana | Predicted polypeptide sequence is paralogous to G2979 |
| 920 | G2980 | PRT | A. thaliana | Paralogous to G2979 |
| 921 | G2982 | DNA | A. thaliana | Predicted polypeptide sequence is paralogous to G2981 |
| 922 | G2982 | PRT | A. thaliana | Paralogous to G2981 |
| 927 | G2989 | DNA | A. thaliana | Predicted polypeptide sequence is paralogous to G2990; orthologous to G3680, G3681, G3691, G3859, G3860, G3861, G3934 |
| 928 | G2989 | PRT | A. thaliana | Paralogous to G2990; Orthologous to G3680, G3681, G3691, G3859, G3860, G3861, G3934 |
| 929 | G2990 | DNA | A. thaliana | Predicted polypeptide sequence is paralogous to G2989; orthologous to G3680, G3681, G3691, G3859, G3860, G3861, G3934 |
| 930 | G2990 | PRT | A. thaliana | Paralogous to G2989; Orthologous to G3680, G3681, G3691, G3859, G3860, G3861, G3934 |
| 933 | G2993 | DNA | A. thaliana | Predicted polypeptide sequence is paralogous to G2994 |
| 934 | G2993 | PRT | A. thaliana | Paralogous to G2994 |
| 939 | G2998 | DNA | A. thaliana | Predicted polypeptide sequence is paralogous to G2999; orthologous to G3663 |
| 940 | G2998 | PRT | A. thaliana | Paralogous to G2999; Orthologous to G3663 |
| 941 | G2999 | DNA | A. thaliana | Predicted polypeptide sequence is paralogous to G2998; orthologous to G3663 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 942 | G2999 | PRT | A. thaliana | Paralogous to G2998; Orthologous to G3663 |
| 943 | G3 | DNA | A. thaliana | Predicted polypeptide sequence is paralogous to G10 |
| 944 | G3 | PRT | A. thaliana | Paralogous to G10 |
| 945 | G30 | DNA | A. thaliana | Predicted polypeptide sequence is paralogous to G1791, G1792, G1795; orthologous to G3380, G3381, G3383, G3515, G3516, G3517, G3518, G3519, G3520, G3735, G3736, G3737, G3794, G3739, G3929, G4328, G4329, G4330 |
| 946 | G30 | PRT | A. thaliana | Paralogous to G1791, G1792, G1795; Orthologous to G3380, G3381, G3383, G3515, G3516, G3517, G3518, G3519, G3520, G3735, G3736, G3737, G3794, G3739, G3929, G4328, G4329, G4330 |
| 951 | G3009 | DNA | A. thaliana | Predicted polypeptide sequence is paralogous to G2738, G307, G308, G309; orthologous to G3816, G3817, G3818, G3819 |
| 952 | G3009 | PRT | A. thaliana | Paralogous to G2738, G307, G308, G309; Orthologous to G3816, G3817, G3818, G3819 |
| 961 | G3034 | DNA | A. thaliana | Predicted polypeptide sequence is paralogous to G1040, G729, G730 |
| 962 | G3034 | PRT | A. thaliana | Paralogous to G1040, G729, G730 |
| 967 | G3041 | DNA | A. thaliana | Predicted polypeptide sequence is paralogous to G760 |
| 968 | G3041 | PRT | A. thaliana | Paralogous to G760 |
| 973 | G306 | DNA | A. thaliana | Predicted polypeptide sequence is orthologous to G3821, G3822 |
| 974 | G306 | PRT | A. thaliana | Orthologous to G3821, G3822 |
| 983 | G3067 | DNA | A. thaliana | Predicted polypeptide sequence is paralogous to G2966 |
| 984 | G3067 | PRT | A. thaliana | Paralogous to G2966 |
| 985 | G3074 | DNA | A. thaliana | Predicted polypeptide sequence is orthologous to G4253, G4254, G4255 |
| 986 | G3074 | PRT | A. thaliana | Orthologous to G4253, G4254, G4255 |
| 989 | G3080 | DNA | A. thaliana | Predicted polypeptide sequence is paralogous to G3079 |
| 990 | G3080 | PRT | A. thaliana | Paralogous to G3079 |
| 991 | G309 | DNA | A. thaliana | Predicted polypeptide sequence is paralogous to G2738, G3009, G307, G308; orthologous to G3816, G3817, G3818, G3819 |
| 992 | G309 | PRT | A. thaliana | Paralogous to G2738, G3009, G307, G308; Orthologous to G3816, G3817, G3818, G3819 |
| 1009 | G326 | DNA | A. thaliana | Predicted polypeptide sequence is paralogous to G1337 |
| 1010 | G326 | PRT | A. thaliana | Paralogous to G1337 |
| 1011 | G328 | DNA | A. thaliana | Predicted polypeptide sequence is paralogous to G2436, G2443 |
| 1012 | G328 | PRT | A. thaliana | Paralogous to G2436, G2443 |
| 1021 | G35 | DNA | A. thaliana | Predicted polypeptide sequence is paralogous to G2138 |
| 1022 | G35 | PRT | A. thaliana | Paralogous to G2138 |
| 1023 | G350 | DNA | A. thaliana | Predicted polypeptide sequence is paralogous to G351, G545 |
| 1024 | G350 | PRT | A. thaliana | Paralogous to G351, G545 |
| 1025 | G351 | DNA | A. thaliana | Predicted polypeptide sequence is paralogous to G350, G545 |
| 1026 | G351 | PRT | A. thaliana | Paralogous to G350, G545 |
| 1027 | G352 | DNA | A. thaliana | Predicted polypeptide sequence is paralogous to G2827 |
| 1028 | G352 | PRT | A. thaliana | Paralogous to G2827 |
| 1029 | G354 | DNA | A. thaliana | Predicted polypeptide sequence is paralogous to G1889, G1974, G2839, G353 |
| 1030 | G354 | PRT | A. thaliana | Paralogous to G1889, G1974, G2839, G353 |
| 1033 | G36 | DNA | A. thaliana | Predicted polypeptide sequence is paralogous to G1748 |
| 1034 | G36 | PRT | A. thaliana | Paralogous to G1748 |
| 1035 | G362 | DNA | A. thaliana | Predicted polypeptide sequence is paralogous to G1995, G2826, G2838, G361, G370 |
| 1036 | G362 | PRT | A. thaliana | Paralogous to G1995, G2826, G2838, G361, G370 |
| 1045 | G383 | DNA | A. thaliana | Predicted polypeptide sequence is paralogous to G1917 |
| 1046 | G383 | PRT | A. thaliana | Paralogous to G1917 |
| 1047 | G385 | DNA | A. thaliana | Predicted polypeptide sequence is paralogous to G1588, G384 |
| 1048 | G385 | PRT | A. thaliana | Paralogous to G1588, G384 |
| 1049 | G392 | DNA | A. thaliana | Predicted polypeptide sequence is paralogous to G1548, G390, G391, G438 |
| 1050 | G392 | PRT | A. thaliana | Paralogous to G1548, G390, G391, G438 |
| 1051 | G399 | DNA | A. thaliana | Predicted polypeptide sequence is paralogous to G398, G964 |
| 1052 | G399 | PRT | A. thaliana | Paralogous to G398, G964 |
| 1053 | G4 | DNA | A. thaliana | Predicted polypeptide sequence is paralogous to G14; orthologous to G3957, G3974 |
| 1054 | G4 | PRT | A. thaliana | Paralogous to G14; Orthologous to G3957, G3974 |
| 1055 | G406 | DNA | A. thaliana | Predicted polypeptide sequence is paralogous to G699 |
| 1056 | G406 | PRT | A. thaliana | Paralogous to G699 |
| 1059 | G411 | DNA | A. thaliana | Predicted polypeptide sequence is paralogous to G2548 |
| 1060 | G411 | PRT | A. thaliana | Paralogous to G2548 |
| 1061 | G413 | DNA | A. thaliana | Predicted polypeptide sequence is paralogous to G713 |
| 1062 | G413 | PRT | A. thaliana | Paralogous to G713 |
| 1067 | G426 | DNA | A. thaliana | Predicted polypeptide sequence is paralogous to G2545, G425, G427 |
| 1068 | G426 | PRT | A. thaliana | Paralogous to G2545, G425, G427 |
| 1069 | G428 | DNA | A. thaliana | Predicted polypeptide sequence is paralogous to G1594 |
| 1070 | G428 | PRT | A. thaliana | Paralogous to G1594 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1071 | G43 | DNA | A. thaliana | Predicted polypeptide sequence is paralogous to G1419, G46, G1004, G29; orthologous to G3849 |
| 1072 | G43 | PRT | A. thaliana | Paralogous to G1419, G46, G1004, G29; Orthologous to G3849 |
| 1077 | G440 | DNA | A. thaliana | Predicted polypeptide sequence is paralogous to G1750, G1421, G864; orthologous to G4079, G4080, G4283, G4284, G4285, G4286, G4287, G4288, G4289, G4290, G4291, G4292, G4293 |
| 1078 | G440 | PRT | A. thaliana | Paralogous to G1750, G1421, G864; Orthologous to G4079, G4080, G4283, G4284, G4285, G4286, G4287, G4288, G4289, G4290, G4291, G4292, G4293 |
| 1079 | G443 | DNA | A. thaliana | Predicted polypeptide sequence is paralogous to G449, G451, G452 |
| 1080 | G443 | PRT | A. thaliana | Paralogous to G449, G451, G452 |
| 1081 | G449 | DNA | A. thaliana | Predicted polypeptide sequence is paralogous to G443, G451, G452 |
| 1082 | G449 | PRT | A. thaliana | Paralogous to G443, G451, G452 |
| 1083 | G450 | DNA | A. thaliana | Predicted polypeptide sequence is paralogous to G448, G455, G456 |
| 1084 | G450 | PRT | A. thaliana | Paralogous to G448, G455, G456 |
| 1085 | G451 | DNA | A. thaliana | Predicted polypeptide sequence is paralogous to G443, G449, G452 |
| 1086 | G451 | PRT | A. thaliana | Paralogous to G443, G449, G452 |
| 1087 | G452 | DNA | A. thaliana | Predicted polypeptide sequence is paralogous to G443, G449, G451 |
| 1088 | G452 | PRT | A. thaliana | Paralogous to G443, G449, G451 |
| 1089 | G463 | DNA | A. thaliana | Predicted polypeptide sequence is paralogous to G464 |
| 1090 | G463 | PRT | A. thaliana | Paralogous to G464 |
| 1091 | G467 | DNA | A. thaliana | Predicted polypeptide sequence is paralogous to G1390 |
| 1092 | G467 | PRT | A. thaliana | Paralogous to G1390 |
| 1093 | G468 | DNA | A. thaliana | Predicted polypeptide sequence is paralogous to G2866 |
| 1094 | G468 | PRT | A. thaliana | Paralogous to G2866 |
| 1095 | G47 | DNA | A. thaliana | Predicted polypeptide sequence is paralogous to G2133; orthologous to G3643, G3644, G3645, G3646, G3647, G3649, G3650, G3651 |
| 1096 | G47 | PRT | A. thaliana | Paralogous to G2133; Orthologous to G3643, G3644, G3645, G3646, G3647, G3649, G3650, G3651 |
| 1097 | G481 | DNA | A. thaliana | Predicted polypeptide sequence is paralogous to G1364, G2345, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1098 | G481 | PRT | A. thaliana | Paralogous to G1364, G2345, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1099 | G482 | DNA | A. thaliana | Predicted polypeptide sequence is paralogous to G1364, G2345, G481, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1100 | G482 | PRT | A. thaliana | Paralogous to G1364, G2345, G481, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1101 | G485 | DNA | A. thaliana | Predicted polypeptide sequence is paralogous to G1364, G2345, G481, G482; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1102 | G485 | PRT | A. thaliana | Paralogous to G1364, G2345, G481, G482; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1103 | G489 | DNA | A. thaliana | Predicted polypeptide sequence is paralogous to G714; orthologous to G3542, G3544, G3545, G3547, G3549, G3550, G3551, G3552, G3553, G3554, G3555, G3867, G3892, G3893, G3894, G3896, G4257, G4256 |
| 1104 | G489 | PRT | A. thaliana | Paralogous to G714; Orthologous to G3542, G3544, G3545, G3547, G3549, G3550, G3551, G3552, G3553, G3554, G3555, G3867, G3892, G3893, G3894, G3896, G4257, G4256 |
| 1105 | G501 | DNA | A. thaliana | Predicted polypeptide sequence is paralogous to G502, G519, G767 |
| 1106 | G501 | PRT | A. thaliana | Paralogous to G502, G519, G767 |
| 1109 | G513 | DNA | A. thaliana | Predicted polypeptide sequence is paralogous to G1426, G1455, G960 |
| 1110 | G513 | PRT | A. thaliana | Paralogous to G1426, G1455, G960 |
| 1111 | G519 | DNA | A. thaliana | Predicted polypeptide sequence is paralogous to G501, G502, G767 |
| 1112 | G519 | PRT | A. thaliana | Paralogous to G501, G502, G767 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1113 | G522 | DNA | A. thaliana | Predicted polypeptide sequence is paralogous to G1354, G1355, G1453, G1766, G2534, G761 |
| 1114 | G522 | PRT | A. thaliana | Paralogous to G1354, G1355, G1453, G1766, G2534, G761 |
| 1115 | G525 | DNA | A. thaliana | Predicted polypeptide sequence is paralogous to G514, G523, G764 |
| 1116 | G525 | PRT | A. thaliana | Paralogous to G514, G523, G764 |
| 1119 | G529 | DNA | A. thaliana | Predicted polypeptide sequence is paralogous to G528, G530, G531, G532, G533, G534, G535, G536, G537 |
| 1120 | G529 | PRT | A. thaliana | Paralogous to G528, G530, G531, G532, G533, G534, G535, G536, G537 |
| 1121 | G530 | DNA | A. thaliana | Predicted polypeptide sequence is paralogous to G528, G529, G531, G532, G533, G534, G535, G536, G537 |
| 1122 | G530 | PRT | A. thaliana | Paralogous to G528, G529, G531, G532, G533, G534, G535, G536, G537 |
| 1123 | G531 | DNA | A. thaliana | Predicted polypeptide sequence is paralogous to G528, G529, G530, G532, G533, G534, G535, G536, G537 |
| 1124 | G531 | PRT | A. thaliana | Paralogous to G528, G529, G530, G532, G533, G534, G535, G536, G537 |
| 1125 | G532 | DNA | A. thaliana | Predicted polypeptide sequence is paralogous to G528, G529, G530, G531, G533, G534, G535, G536, G537 |
| 1126 | G532 | PRT | A. thaliana | Paralogous to G528, G529, G530, G531, G533, G534, G535, G536, G537 |
| 1127 | G547 | DNA | A. thaliana | Predicted polypeptide sequence is paralogous to G1832 |
| 1128 | G547 | PRT | A. thaliana | Paralogous to G1832 |
| 1131 | G556 | DNA | A. thaliana | Predicted polypeptide sequence is paralogous to G1198, G1806, G554, G555, G558, G578, G629 |
| 1132 | G556 | PRT | A. thaliana | Paralogous to G1198, G1806, G554, G555, G558, G578, G629 |
| 1133 | G558 | DNA | A. thaliana | Predicted polypeptide sequence is paralogous to G1198, G1806, G554, G555, G556, G578, G629 |
| 1134 | G558 | PRT | A. thaliana | Paralogous to G1198, G1806, G554, G555, G556, G578, G629 |
| 1135 | G559 | DNA | A. thaliana | Predicted polypeptide sequence is paralogous to G631 |
| 1136 | G559 | PRT | A. thaliana | Paralogous to G631 |
| 1137 | G562 | DNA | A. thaliana | Predicted polypeptide sequence is paralogous to G561 |
| 1138 | G562 | PRT | A. thaliana | Paralogous to G561 |
| 1143 | G568 | DNA | A. thaliana | Predicted polypeptide sequence is paralogous to G580 |
| 1144 | G568 | PRT | A. thaliana | Paralogous to G580 |
| 1145 | G577 | DNA | A. thaliana | Predicted polypeptide sequence is paralogous to G1078 |
| 1146 | G577 | PRT | A. thaliana | Paralogous to G1078 |
| 1149 | G580 | DNA | A. thaliana | Predicted polypeptide sequence is paralogous to G568 |
| 1150 | G580 | PRT | A. thaliana | Paralogous to G568 |
| 1153 | G591 | DNA | A. thaliana | Predicted polypeptide sequence is paralogous to G793; orthologous to G3752, G3753, G3751, G3750, G4311, G4312, G4313 |
| 1154 | G591 | PRT | A. thaliana | Paralogous to G793; Orthologous to G3752, G3753, G3751, G3750, G4311, G4312, G4313 |
| 1157 | G596 | DNA | A. thaliana | Predicted polypeptide sequence is paralogous to G2789; orthologous to G3457 |
| 1158 | G596 | PRT | A. thaliana | Paralogous to G2789; Orthologous to G3457 |
| 1161 | G599 | DNA | A. thaliana | Predicted polypeptide sequence is paralogous to G2159, G2781 |
| 1162 | G599 | PRT | A. thaliana | Paralogous to G2159, G2781 |
| 1169 | G631 | DNA | A. thaliana | Predicted polypeptide sequence is paralogous to G559 |
| 1170 | G631 | PRT | A. thaliana | Paralogous to G559 |
| 1183 | G653 | DNA | A. thaliana | Predicted polypeptide sequence is paralogous to G654 |
| 1184 | G653 | PRT | A. thaliana | Paralogous to G654 |
| 1189 | G659 | DNA | A. thaliana | Predicted polypeptide sequence is paralogous to G1323 |
| 1190 | G659 | PRT | A. thaliana | Paralogous to G1323 |
| 1191 | G663 | DNA | A. thaliana | Predicted polypeptide sequence is paralogous to G1329, G2421, G2422 |
| 1192 | G663 | PRT | A. thaliana | Paralogous to G1329, G2421, G2422 |
| 1193 | G664 | DNA | A. thaliana | Predicted polypeptide sequence is paralogous to G197, G255; orthologous to G3503, G3504, G3505, G3506, G3507, G3508, G3509, G3529, G3531, G3532, G3533, G3534, G3527, G3528, G4637, G4638, G4639, G4640 |
| 1194 | G664 | PRT | A. thaliana | Paralogous to G197, G255; Orthologous to G3503, G3504, G3505, G3506, G3507, G3508, G3509, G3529, G3531, G3532, G3533, G3534, G3527, G3528, G4637, G4638, G4639, G4640 |
| 1197 | G666 | DNA | A. thaliana | Predicted polypeptide sequence is paralogous to G256, G668, G932; orthologous to G3384, G3385, G3386, G3500, G3501, G3502, G3537, G3538, G3539, G3540, G3541 |
| 1198 | G666 | PRT | A. thaliana | Paralogous to G256, G668, G932; Orthologous to G3384, G3385, G3386, G3500, G3501, G3502, G3537, G3538, G3539, G3540, G3541 |
| 1205 | G682 | DNA | A. thaliana | Predicted polypeptide sequence is paralogous to G1816, G225, G226, G2718, G3930; orthologous to G3392, G3393, G3431, G3444, G3445, G3446, G3447, G3448, G3449, G3450 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1206 | G682 | PRT | A. thaliana | Paralogous to G1816, G225, G226, G2718, G3930; Orthologous to G3392, G3393, G3431, G3444, G3445, G3446, G3447, G3448, G3449, G3450 |
| 1207 | G699 | DNA | A. thaliana | Predicted polypeptide sequence is paralogous to G406 |
| 1208 | G699 | PRT | A. thaliana | Paralogous to G406 |
| 1211 | G707 | DNA | A. thaliana | Predicted polypeptide sequence is paralogous to G386 |
| 1212 | G707 | PRT | A. thaliana | Paralogous to G386 |
| 1213 | G714 | DNA | A. thaliana | Predicted polypeptide sequence is paralogous to G489; orthologous to G3542, G3544, G3545, G3547, G3549, G3550, G3551, G3552, G3553, G3554, G3555, G3867, G3892, G3893, G3894, G3896, G4257, G4256 |
| 1214 | G714 | PRT | A. thaliana | Paralogous to G489; Orthologous to G3542, G3544, G3545, G3547, G3549, G3550, G3551, G3552, G3553, G3554, G3555, G3867, G3892, G3893, G3894, G3896, G4257, G4256 |
| 1215 | G715 | DNA | A. thaliana | Predicted polypeptide sequence is paralogous to G1646; orthologous to G3883, G3884, G3885, G3886, G3889, G3543, G4259 |
| 1216 | G715 | PRT | A. thaliana | Paralogous to G1646; Orthologous to G3883, G3884, G3885, G3886, G3889, G3543, G4259 |
| 1219 | G721 | DNA | A. thaliana | Predicted polypeptide sequence is paralogous to G1041, G724 |
| 1220 | G721 | PRT | A. thaliana | Paralogous to G1041, G724 |
| 1221 | G722 | DNA | A. thaliana | Predicted polypeptide sequence is paralogous to G1037 |
| 1222 | G722 | PRT | A. thaliana | Paralogous to G1037 |
| 1223 | G724 | DNA | A. thaliana | Predicted polypeptide sequence is paralogous to G1041, G721 |
| 1224 | G724 | PRT | A. thaliana | Paralogous to G1041, G721 |
| 1225 | G727 | DNA | A. thaliana | Predicted polypeptide sequence is paralogous to G1493 |
| 1226 | G727 | PRT | A. thaliana | Paralogous to G1493 |
| 1227 | G730 | DNA | A. thaliana | Predicted polypeptide sequence is paralogous to G1040, G3034, G729 |
| 1228 | G730 | PRT | A. thaliana | Paralogous to G1040, G3034, G729 |
| 1229 | G732 | DNA | A. thaliana | Predicted polypeptide sequence is paralogous to G1035 |
| 1230 | G732 | PRT | A. thaliana | Paralogous to G1035 |
| 1231 | G748 | DNA | A. thaliana | Predicted polypeptide sequence is paralogous to G1900 |
| 1232 | G748 | PRT | A. thaliana | Paralogous to G1900 |
| 1239 | G763 | DNA | A. thaliana | Predicted polypeptide sequence is paralogous to G524 |
| 1240 | G763 | PRT | A. thaliana | Paralogous to G524 |
| 1241 | G764 | DNA | A. thaliana | Predicted polypeptide sequence is paralogous to G514, G523, G525 |
| 1242 | G764 | PRT | A. thaliana | Paralogous to G514, G523, G525 |
| 1247 | G789 | DNA | A. thaliana | Predicted polypeptide sequence is paralogous to G1494 |
| 1248 | G789 | PRT | A. thaliana | Paralogous to G1494 |
| 1249 | G790 | DNA | A. thaliana | Predicted polypeptide sequence is paralogous to G593 |
| 1250 | G790 | PRT | A. thaliana | Paralogous to G593 |
| 1251 | G792 | DNA | A. thaliana | Predicted polypeptide sequence is paralogous to G791 |
| 1252 | G792 | PRT | A. thaliana | Paralogous to G791 |
| 1253 | G793 | DNA | A. thaliana | Predicted polypeptide sequence is paralogous to G591; orthologous to G3752, G3753, G3751, G3750, G4311, G4312, G4313 |
| 1254 | G793 | PRT | A. thaliana | Paralogous to G591; Orthologous to G3752, G3753, G3751, G3750, G4311, G4312, G4313 |
| 1257 | G810 | DNA | A. thaliana | Predicted polypeptide sequence is paralogous to G807; orthologous to G3491, G3494, G3495, G3512 |
| 1258 | G810 | PRT | A. thaliana | Paralogous to G807; Orthologous to G3491, G3494, G3495, G3512 |
| 1261 | G812 | DNA | A. thaliana | Predicted polypeptide sequence is paralogous to G2467 |
| 1262 | G812 | PRT | A. thaliana | Paralogous to G2467 |
| 1263 | G819 | DNA | A. thaliana | Predicted polypeptide sequence is paralogous to G273 |
| 1264 | G819 | PRT | A. thaliana | Paralogous to G273 |
| 1273 | G881 | DNA | A. thaliana | Predicted polypeptide sequence is paralogous to G986 |
| 1274 | G881 | PRT | A. thaliana | Paralogous to G986 |
| 1277 | G896 | DNA | A. thaliana | Predicted polypeptide sequence is paralogous to G1349, G1887 |
| 1278 | G896 | PRT | A. thaliana | Paralogous to G1349, G1887 |
| 1279 | G897 | DNA | A. thaliana | Predicted polypeptide sequence is paralogous to G1480, G899 |
| 1280 | G897 | PRT | A. thaliana | Paralogous to G1480, G899 |
| 1281 | G902 | DNA | A. thaliana | Predicted polypeptide sequence is paralogous to G1881 |
| 1282 | G902 | PRT | A. thaliana | Paralogous to G1881 |
| 1293 | G927 | DNA | A. thaliana | Predicted polypeptide sequence is paralogous to G1334 |
| 1294 | G927 | PRT | A. thaliana | Paralogous to G1334 |
| 1295 | G929 | DNA | A. thaliana | Predicted polypeptide sequence is paralogous to G2344; orthologous to G4267, G4268 |
| 1296 | G929 | PRT | A. thaliana | Paralogous to G2344; Orthologous to G4267, G4268 |
| 1297 | G934 | DNA | A. thaliana | Predicted polypeptide sequence is paralogous to G2869, G2870, G2871, G2872, G2873 |
| 1298 | G934 | PRT | A. thaliana | Paralogous to G2869, G2870, G2871, G2872, G2873 |
| 1303 | G938 | DNA | A. thaliana | Predicted polypeptide sequence is paralogous to G940, G941 |
| 1304 | G938 | PRT | A. thaliana | Paralogous to G940, G941 |
| 1307 | G941 | DNA | A. thaliana | Predicted polypeptide sequence is paralogous to G938, G940 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1308 | G941 | PRT | A. thaliana | Paralogous to G938, G940 |
| 1309 | G961 | DNA | A. thaliana | Predicted polypeptide sequence is paralogous to G2535, G957 |
| 1310 | G961 | PRT | A. thaliana | Paralogous to G2535, G957 |
| 1315 | G975 | DNA | A. thaliana | Predicted polypeptide sequence is paralogous to G1387, G2583; orthologous to G4294 |
| 1316 | G975 | PRT | A. thaliana | Paralogous to G1387, G2583; Orthologous to G4294 |
| 1317 | G976 | DNA | A. thaliana | Predicted polypeptide sequence is paralogous to G913, G2514, G1753 |
| 1318 | G976 | PRT | A. thaliana | Paralogous to G913, G2514, G1753 |
| 1319 | G979 | DNA | A. thaliana | Predicted polypeptide sequence is paralogous to G2106, G2131 |
| 1320 | G979 | PRT | A. thaliana | Paralogous to G2106, G2131 |
| 1325 | G993 | DNA | A. thaliana | Predicted polypeptide sequence is paralogous to G1930, G867, G9; orthologous to G3388, G3389, G3390, G3391, G3432, G3433, G3451, G3452, G3453, G3454, G3455 |
| 1326 | G993 | PRT | A. thaliana | Paralogous to G1930, G867, G9; Orthologous to G3388, G3389, G3390, G3391, G3432, G3433, G3451, G3452, G3453, G3454, G3455 |
| 1327 | G997 | DNA | A. thaliana | Predicted polypeptide sequence is paralogous to G1789, G1911, G2721 |
| 1328 | G997 | PRT | A. thaliana | Paralogous to G1789, G1911, G2721 |
| 1331 | G10 | DNA | A. thaliana | Predicted polypeptide sequence is paralogous to G3 |
| 1332 | G10 | PRT | A. thaliana | Paralogous to G3 |
| 1333 | G1010 | DNA | A. thaliana | Predicted polypeptide sequence is paralogous to G2747 |
| 1334 | G1010 | PRT | A. thaliana | Paralogous to G2747 |
| 1335 | G1011 | DNA | A. thaliana | Predicted polypeptide sequence is paralogous to G149, G627, G154, G1797, G1798; orthologous to G4061, G4062, G4063, G4064, G4065, G4066, G4067 |
| 1336 | G1011 | PRT | A. thaliana | Paralogous to G149, G627, G154, G1797, G1798; Orthologous to G4061, G4062, G4063, G4064, G4065, G4066, G4067 |
| 1337 | G1029 | DNA | A. thaliana | Predicted polypeptide sequence is paralogous to G1033, G279 |
| 1338 | G1029 | PRT | A. thaliana | Paralogous to G1033, G279 |
| 1339 | G1035 | DNA | A. thaliana | Predicted polypeptide sequence is paralogous to G732 |
| 1340 | G1035 | PRT | A. thaliana | Paralogous to G732 |
| 1341 | G1037 | DNA | A. thaliana | Predicted polypeptide sequence is paralogous to G722 |
| 1342 | G1037 | PRT | A. thaliana | Paralogous to G722 |
| 1343 | G1040 | DNA | A. thaliana | Predicted polypeptide sequence is paralogous to G3034, G729, G730 |
| 1344 | G1040 | PRT | A. thaliana | Paralogous to G3034, G729, G730 |
| 1345 | G1041 | DNA | A. thaliana | Predicted polypeptide sequence is paralogous to G721, G724 |
| 1346 | G1041 | PRT | A. thaliana | Paralogous to G721, G724 |
| 1347 | G1047 | DNA | A. thaliana | Predicted polypeptide sequence is paralogous to G1808 |
| 1348 | G1047 | PRT | A. thaliana | Paralogous to G1808 |
| 1349 | G1050 | DNA | A. thaliana | Predicted polypeptide sequence is paralogous to G1807 |
| 1350 | G1050 | PRT | A. thaliana | Paralogous to G1807 |
| 1351 | G1058 | DNA | A. thaliana | Predicted polypeptide sequence is paralogous to G2071 |
| 1352 | G1058 | PRT | A. thaliana | Paralogous to G2071 |
| 1353 | G1061 | DNA | A. thaliana | Predicted polypeptide sequence is paralogous to G589, G2791; orthologous to G3748, G3749, G3774, G3760 |
| 1354 | G1061 | PRT | A. thaliana | Paralogous to G589, G2791; Orthologous to G3748, G3749, G3774, G3760 |
| 1355 | G1073 | DNA | A. thaliana | Predicted polypeptide sequence is paralogous to G1067, G2156; orthologous to G3399, G3400 |
| 1356 | G1073 | PRT | A. thaliana | Paralogous to G1067, G2156; Orthologous to G3399, G3400 |
| 1357 | G1075 | DNA | A. thaliana | Predicted polypeptide sequence is paralogous to G1076; orthologous to G3406, G3407, G3458, G3459, G3460, G3461 |
| 1358 | G1075 | PRT | A. thaliana | Paralogous to G1076; Orthologous to G3406, G3407, G3458, G3459, G3460, G3461 |
| 1359 | G1108 | DNA | A. thaliana | Predicted polypeptide sequence is paralogous to G2394 |
| 1360 | G1108 | PRT | A. thaliana | Paralogous to G2394 |
| 1361 | G1149 | DNA | A. thaliana | Predicted polypeptide sequence is paralogous to G1146, G1152 |
| 1362 | G1149 | PRT | A. thaliana | Paralogous to G1146, G1152 |
| 1363 | G1152 | DNA | A. thaliana | Predicted polypeptide sequence is paralogous to G1146, G1149 |
| 1364 | G1152 | PRT | A. thaliana | Paralogous to G1146, G1149 |
| 1365 | G1181 | DNA | A. thaliana | Predicted polypeptide sequence is paralogous to G1850 |
| 1366 | G1181 | PRT | A. thaliana | Paralogous to G1850 |
| 1367 | G1186 | DNA | A. thaliana | Predicted polypeptide sequence is paralogous to G1855 |
| 1368 | G1186 | PRT | A. thaliana | Paralogous to G1855 |
| 1369 | G1197 | DNA | A. thaliana | Predicted polypeptide sequence is paralogous to G1959 |
| 1370 | G1197 | PRT | A. thaliana | Paralogous to G1959 |
| 1371 | G12 | DNA | A. thaliana | Predicted polypeptide sequence is paralogous to G1277, G1379, G24; orthologous to G3656 |
| 1372 | G12 | PRT | A. thaliana | Paralogous to G1277, G1379, G24; Orthologous to G3656 |
| 1373 | G1227 | DNA | A. thaliana | Predicted polypeptide sequence is paralogous to G1228 |
| 1374 | G1227 | PRT | A. thaliana | Paralogous to G1228 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1375 | G1232 | DNA | A. thaliana | Predicted polypeptide sequence is paralogous to G2484 |
| 1376 | G1232 | PRT | A. thaliana | Paralogous to G2484 |
| 1377 | G1241 | DNA | A. thaliana | Predicted polypeptide sequence is paralogous to G1240 |
| 1378 | G1241 | PRT | A. thaliana | Paralogous to G1240 |
| 1379 | G1242 | DNA | A. thaliana | Predicted polypeptide sequence is paralogous to G1243 |
| 1380 | G1242 | PRT | A. thaliana | Paralogous to G1243 |
| 1381 | G1245 | DNA | A. thaliana | Predicted polypeptide sequence is paralogous to G1247 |
| 1382 | G1245 | PRT | A. thaliana | Paralogous to G1247 |
| 1383 | G1277 | DNA | A. thaliana | Predicted polypeptide sequence is paralogous to G12, G1379, G24; orthologous to G3656 |
| 1384 | G1277 | PRT | A. thaliana | Paralogous to G12, G1379, G24; Orthologous to G3656 |
| 1385 | G129 | DNA | A. thaliana | Predicted polypeptide sequence is paralogous to G136, G140, G146 |
| 1386 | G129 | PRT | A. thaliana | Paralogous to G136, G140, G146 |
| 1387 | G1307 | DNA | A. thaliana | Predicted polypeptide sequence is paralogous to G206 |
| 1388 | G1307 | PRT | A. thaliana | Paralogous to G206 |
| 1389 | G1321 | DNA | A. thaliana | Predicted polypeptide sequence is paralogous to G1320 |
| 1390 | G1321 | PRT | A. thaliana | Paralogous to G1320 |
| 1391 | G1323 | DNA | A. thaliana | Predicted polypeptide sequence is paralogous to G659 |
| 1392 | G1323 | PRT | A. thaliana | Paralogous to G659 |
| 1393 | G1325 | DNA | A. thaliana | Predicted polypeptide sequence is paralogous to G1313 |
| 1394 | G1325 | PRT | A. thaliana | Paralogous to G1313 |
| 1395 | G1329 | DNA | A. thaliana | Predicted polypeptide sequence is paralogous to G2421, G2422, G663 |
| 1396 | G1329 | PRT | A. thaliana | Paralogous to G2421, G2422, G663 |
| 1397 | G1334 | DNA | A. thaliana | Predicted polypeptide sequence is paralogous to G927 |
| 1398 | G1334 | PRT | A. thaliana | Paralogous to G927 |
| 1399 | G1337 | DNA | A. thaliana | Predicted polypeptide sequence is paralogous to G326 |
| 1400 | G1337 | PRT | A. thaliana | Paralogous to G326 |
| 1401 | G136 | DNA | A. thaliana | Predicted polypeptide sequence is paralogous to G129, G140, G146 |
| 1402 | G136 | PRT | A. thaliana | Paralogous to G129, G140, G146 |
| 1403 | G1381 | DNA | A. thaliana | Predicted polypeptide sequence is paralogous to G21 |
| 1404 | G1381 | PRT | A. thaliana | Paralogous to G21 |
| 1405 | G1387 | DNA | A. thaliana | Predicted polypeptide sequence is paralogous to G2583, G975; orthologous to G4294 |
| 1406 | G1387 | PRT | A. thaliana | Paralogous to G2583, G975; Orthologous to G4294 |
| 1407 | G1390 | DNA | A. thaliana | Predicted polypeptide sequence is paralogous to G467 |
| 1408 | G1390 | PRT | A. thaliana | Paralogous to G467 |
| 1409 | G1396 | DNA | A. thaliana | Predicted polypeptide sequence is paralogous to G1394, G1395 |
| 1410 | G1396 | PRT | A. thaliana | Paralogous to G1394, G1395 |
| 1411 | G14 | DNA | A. thaliana | Predicted polypeptide sequence is paralogous to G4; orthologous to G3957, G3974 |
| 1412 | G14 | PRT | A. thaliana | Paralogous to G4; Orthologous to G3957, G3974 |
| 1413 | G1416 | DNA | A. thaliana | Predicted polypeptide sequence is paralogous to G2 |
| 1414 | G1416 | PRT | A. thaliana | Paralogous to G2 |
| 1415 | G142 | DNA | A. thaliana | Predicted polypeptide sequence is paralogous to G148 |
| 1416 | G142 | PRT | A. thaliana | Paralogous to G148 |
| 1417 | G1424 | DNA | A. thaliana | Predicted polypeptide sequence is paralogous to G1423, G2988 |
| 1418 | G1424 | PRT | A. thaliana | Paralogous to G1423, G2988 |
| 1419 | G1426 | DNA | A. thaliana | Predicted polypeptide sequence is paralogous to G1455, G513, G960 |
| 1420 | G1426 | PRT | A. thaliana | Paralogous to G1455, G513, G960 |
| 1421 | G1453 | DNA | A. thaliana | Predicted polypeptide sequence is paralogous to G1354, G1355, G1766, G2534, G522, G761 |
| 1422 | G1453 | PRT | A. thaliana | Paralogous to G1354, G1355, G1766, G2534, G522, G761 |
| 1423 | G1455 | DNA | A. thaliana | Predicted polypeptide sequence is paralogous to G1426, G513, G960 |
| 1424 | G1455 | PRT | A. thaliana | Paralogous to G1426, G513, G960 |
| 1425 | G1458 | DNA | A. thaliana | Predicted polypeptide sequence is paralogous to G1459, G1460 |
| 1426 | G1458 | PRT | A. thaliana | Paralogous to G1459, G1460 |
| 1427 | G1459 | DNA | A. thaliana | Predicted polypeptide sequence is paralogous to G1458, G1460 |
| 1428 | G1459 | PRT | A. thaliana | Paralogous to G1458, G1460 |
| 1429 | G1461 | DNA | A. thaliana | Predicted polypeptide sequence is paralogous to G1462, G1463, G1464, G1465 |
| 1430 | G1461 | PRT | A. thaliana | Paralogous to G1462, G1463, G1464, G1465 |
| 1431 | G1463 | DNA | A. thaliana | Predicted polypeptide sequence is paralogous to G1461, G1462, G1464, G1465 |
| 1432 | G1463 | PRT | A. thaliana | Paralogous to G1461, G1462, G1464, G1465 |
| 1433 | G1464 | DNA | A. thaliana | Predicted polypeptide sequence is paralogous to G1461, G1462, G1463, G1465 |
| 1434 | G1464 | PRT | A. thaliana | Paralogous to G1461, G1462, G1463, G1465 |
| 1435 | G1465 | DNA | A. thaliana | Predicted polypeptide sequence is paralogous to G1461, G1462, G1463, G1464 |
| 1436 | G1465 | PRT | A. thaliana | Paralogous to G1461, G1462, G1463, G1464 |
| 1437 | G1466 | DNA | A. thaliana | Predicted polypeptide sequence is paralogous to G224, G1021, G223 |
| 1438 | G1466 | PRT | A. thaliana | Paralogous to G224, G1021, G223 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1439 | G1482 | DNA | A. thaliana | Predicted polypeptide sequence is paralogous to G1888; orthologous to G5159 |
| 1440 | G1482 | PRT | A. thaliana | Paralogous to G1888; Orthologous to G5159 |
| 1441 | G1489 | DNA | A. thaliana | Predicted polypeptide sequence is paralogous to G1488 |
| 1442 | G1489 | PRT | A. thaliana | Paralogous to G1488 |
| 1443 | G149 | DNA | A. thaliana | Predicted polypeptide sequence is paralogous to G627, G1011, G154, G1797, G1798; orthologous to G4061, G4062, G4063, G4064, G4065, G4066, G4067 |
| 1444 | G149 | PRT | A. thaliana | Paralogous to G627, G1011, G154, G1797, G1798; Orthologous to G4061, G4062, G4063, G4064, G4065, G4066, G4067 |
| 1445 | G1492 | DNA | A. thaliana | Predicted polypeptide sequence is paralogous to G2742 |
| 1446 | G1492 | PRT | A. thaliana | Paralogous to G2742 |
| 1447 | G1493 | DNA | A. thaliana | Predicted polypeptide sequence is paralogous to G727 |
| 1448 | G1493 | PRT | A. thaliana | Paralogous to G727 |
| 1449 | G1507 | DNA | A. thaliana | Predicted polypeptide sequence is paralogous to G2437 |
| 1450 | G1507 | PRT | A. thaliana | Paralogous to G2437 |
| 1451 | G1508 | DNA | A. thaliana | Predicted polypeptide sequence is paralogous to G2094 |
| 1452 | G1508 | PRT | A. thaliana | Paralogous to G2094 |
| 1453 | G1509 | DNA | A. thaliana | Predicted polypeptide sequence is paralogous to G1506 |
| 1454 | G1509 | PRT | A. thaliana | Paralogous to G1506 |
| 1455 | G152 | DNA | A. thaliana | Predicted polypeptide sequence is paralogous to G153, G1760, G860; orthologous to G3479, G3480, G3481, G3482, G3483, G3484, G3485, G3487, G3488, G3489, G3980, G3981, G3982 |
| 1456 | G152 | PRT | A. thaliana | Paralogous to G153, G1760, G860; Orthologous to G3479, G3480, G3481, G3482, G3483, G3484, G3485, G3487, G3488, G3489, G3980, G3981, G3982 |
| 1457 | G153 | DNA | A. thaliana | Predicted polypeptide sequence is paralogous to G152, G1760, G860; orthologous to G3479, G3480, G3481, G3482, G3483, G3484, G3485, G3487, G3488, G3489, G3980, G3981, G3982 |
| 1458 | G153 | PRT | A. thaliana | Paralogous to G152, G1760, G860; Orthologous to G3479, G3480, G3481, G3482, G3483, G3484, G3485, G3487, G3488, G3489, G3980, G3981, G3982 |
| 1459 | G1545 | DNA | A. thaliana | Predicted polypeptide sequence is paralogous to G1538, G412 |
| 1460 | G1545 | PRT | A. thaliana | Paralogous to G1538, G412 |
| 1461 | G1548 | DNA | A. thaliana | Predicted polypeptide sequence is paralogous to G390, G391, G392, G438 |
| 1462 | G1548 | PRT | A. thaliana | Paralogous to G390, G391, G392, G438 |
| 1463 | G1588 | DNA | A. thaliana | Predicted polypeptide sequence is paralogous to G384, G385 |
| 1464 | G1588 | PRT | A. thaliana | Paralogous to G384, G385 |
| 1465 | G1594 | DNA | A. thaliana | Predicted polypeptide sequence is paralogous to G428 |
| 1466 | G1594 | PRT | A. thaliana | Paralogous to G428 |
| 1467 | G16 | DNA | A. thaliana | Predicted polypeptide sequence is paralogous to G2299 |
| 1468 | G16 | PRT | A. thaliana | Paralogous to G2299 |
| 1469 | G164 | DNA | A. thaliana | Predicted polypeptide sequence is paralogous to G166 |
| 1470 | G164 | PRT | A. thaliana | Paralogous to G166 |
| 1471 | G1641 | DNA | A. thaliana | Predicted polypeptide sequence is paralogous to G1638, G2452, G1634, G2701 |
| 1472 | G1641 | PRT | A. thaliana | Paralogous to G1638, G2452, G1634, G2701 |
| 1473 | G1664 | DNA | A. thaliana | Predicted polypeptide sequence is paralogous to G1062 |
| 1474 | G1664 | PRT | A. thaliana | Paralogous to G1062 |
| 1475 | G1672 | DNA | A. thaliana | Predicted polypeptide sequence is paralogous to G2802 |
| 1476 | G1672 | PRT | A. thaliana | Paralogous to G2802 |
| 1477 | G170 | DNA | A. thaliana | Predicted polypeptide sequence is paralogous to G168, G2065 |
| 1478 | G170 | PRT | A. thaliana | Paralogous to G168, G2065 |
| 1479 | G1748 | DNA | A. thaliana | Predicted polypeptide sequence is paralogous to G36 |
| 1480 | G1748 | PRT | A. thaliana | Paralogous to G36 |
| 1481 | G1749 | DNA | A. thaliana | Predicted polypeptide sequence is paralogous to G1839, G1840 |
| 1482 | G1749 | PRT | A. thaliana | Paralogous to G1839, G1840 |
| 1483 | G1753 | DNA | A. thaliana | Predicted polypeptide sequence is paralogous to G913, G2514, G976 |
| 1484 | G1753 | PRT | A. thaliana | Paralogous to G913, G2514, G976 |
| 1485 | G1754 | DNA | A. thaliana | Predicted polypeptide sequence is paralogous to G1755 |
| 1486 | G1754 | PRT | A. thaliana | Paralogous to G1755 |
| 1487 | G1766 | DNA | A. thaliana | Predicted polypeptide sequence is paralogous to G1354, G1355, G1453, G2534, G522, G761 |
| 1488 | G1766 | PRT | A. thaliana | Paralogous to G1354, G1355, G1453, G2534, G522, G761 |
| 1489 | G1768 | DNA | A. thaliana | Predicted polypeptide sequence is paralogous to G2633, G2697, G313, G852; orthologous to G3815, G3825 |
| 1490 | G1768 | PRT | A. thaliana | Paralogous to G2633, G2697, G313, G852; Orthologous to G3815, G3825 |
| 1491 | G1779 | DNA | A. thaliana | Predicted polypeptide sequence is paralogous to G1510 |
| 1492 | G1779 | PRT | A. thaliana | Paralogous to G1510 |
| 1493 | G1791 | DNA | A. thaliana | Predicted polypeptide sequence is paralogous to G1792, G1795, G30; orthologous to G3380, G3381, G3383, G3515, G3516, G3517, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3518, G3519, G3520, G3735, G3736, G3737, G3794, G3739, G3929, G4328, G4329, G4330 |
| 1494 | G1791 | PRT | A. thaliana | Paralogous to G1792, G1795, G30; Orthologous to G3380, G3381, G3383, G3515, G3516, G3517, G3518, G3519, G3520, G3735, G3736, G3737, G3794, G3739, G3929, G4328, G4329, G4330 |
| 1495 | G1792 | DNA | A. thaliana | Predicted polypeptide sequence is paralogous to G1791, G1795, G30; orthologous to G3380, G3381, G3383, G3515, G3516, G3517, G3518, G3519, G3520, G3735, G3736, G3737, G3794, G3739, G3929, G4328, G4329, G4330 |
| 1496 | G1792 | PRT | A. thaliana | Paralogous to G1791, G1795, G30; Orthologous to G3380, G3381, G3383, G3515, G3516, G3517, G3518, G3519, G3520, G3735, G3736, G3737, G3794, G3739, G3929, G4328, G4329, G4330 |
| 1497 | G1795 | DNA | A. thaliana | Predicted polypeptide sequence is paralogous to G1791, G1792, G30; orthologous to G3380, G3381, G3383, G3515, G3516, G3517, G3518, G3519, G3520, G3735, G3736, G3737, G3794, G3739, G3929, G4328, G4329, G4330 |
| 1498 | G1795 | PRT | A. thaliana | Paralogous to G1791, G1792, G30; Orthologous to G3380, G3381, G3383, G3515, G3516, G3517, G3518, G3519, G3520, G3735, G3736, G3737, G3794, G3739, G3929, G4328, G4329, G4330 |
| 1499 | G1798 | DNA | A. thaliana | Predicted polypeptide sequence is paralogous to G149, G627, G1011, G154, G1797; orthologous to G4061, G4062, G4063, G4064, G4065, G4066, G4067 |
| 1500 | G1798 | PRT | A. thaliana | Paralogous to G149, G627, G1011, G154, G1797; Orthologous to G4061, G4062, G4063, G4064, G4065, G4066, G4067 |
| 1501 | G1816 | DNA | A. thaliana | Predicted polypeptide sequence is paralogous to G225, G226, G2718, G682, G3930; orthologous to G3392, G3393, G3431, G3444, G3445, G3446, G3447, G3448, G3449, G3450 |
| 1502 | G1816 | PRT | A. thaliana | Paralogous to G225, G226, G2718, G682, G3930; Orthologous to G3392, G3393, G3431, G3444, G3445, G3446, G3447, G3448, G3449, G3450 |
| 1503 | G1817 | DNA | A. thaliana | Predicted polypeptide sequence is paralogous to G2316 |
| 1504 | G1817 | PRT | A. thaliana | Paralogous to G2316 |
| 1505 | G1818 | DNA | A. thaliana | Predicted polypeptide sequence is paralogous to G1836 |
| 1506 | G1818 | PRT | A. thaliana | Paralogous to G1836 |
| 1507 | G1832 | DNA | A. thaliana | Predicted polypeptide sequence is paralogous to G547 |
| 1508 | G1832 | PRT | A. thaliana | Paralogous to G547 |
| 1509 | G1840 | DNA | A. thaliana | Predicted polypeptide sequence is paralogous to G1749, G1839 |
| 1510 | G1840 | PRT | A. thaliana | Paralogous to G1749, G1839 |
| 1511 | G1846 | DNA | A. thaliana | Predicted polypeptide sequence is paralogous to G1007 |
| 1512 | G1846 | PRT | A. thaliana | Paralogous to G1007 |
| 1513 | G1868 | DNA | A. thaliana | Predicted polypeptide sequence is paralogous to G1439 |
| 1514 | G1868 | PRT | A. thaliana | Paralogous to G1439 |
| 1515 | G1879 | DNA | A. thaliana | Predicted polypeptide sequence is paralogous to G2655 |
| 1516 | G1879 | PRT | A. thaliana | Paralogous to G2655 |
| 1517 | G1887 | DNA | A. thaliana | Predicted polypeptide sequence is paralogous to G1349, G896 |
| 1518 | G1887 | PRT | A. thaliana | Paralogous to G1349, G896 |
| 1519 | G1889 | DNA | A. thaliana | Predicted polypeptide sequence is paralogous to G1974, G2839, G353, G354 |
| 1520 | G1889 | PRT | A. thaliana | Paralogous to G1974, G2839, G353, G354 |
| 1521 | G1891 | DNA | A. thaliana | Predicted polypeptide sequence is paralogous to G1965 |
| 1522 | G1891 | PRT | A. thaliana | Paralogous to G1965 |
| 1523 | G1895 | DNA | A. thaliana | Predicted polypeptide sequence is paralogous to G1903 |
| 1524 | G1895 | PRT | A. thaliana | Paralogous to G1903 |
| 1525 | G1900 | DNA | A. thaliana | Predicted polypeptide sequence is paralogous to G748 |
| 1526 | G1900 | PRT | A. thaliana | Paralogous to G748 |
| 1527 | G1902 | DNA | A. thaliana | Predicted polypeptide sequence is paralogous to G1901 |
| 1528 | G1902 | PRT | A. thaliana | Paralogous to G1901 |
| 1529 | G1911 | DNA | A. thaliana | Predicted polypeptide sequence is paralogous to G1789, G2721, G997 |
| 1530 | G1911 | PRT | A. thaliana | Paralogous to G1789, G2721, G997 |
| 1531 | G1927 | DNA | A. thaliana | Predicted polypeptide sequence is paralogous to G1456, G2184 |
| 1532 | G1927 | PRT | A. thaliana | Paralogous to G1456, G2184 |
| 1533 | G1929 | DNA | A. thaliana | Predicted polypeptide sequence is paralogous to G1478; orthologous to G4019 |
| 1534 | G1929 | PRT | A. thaliana | Paralogous to G1478; Orthologous to G4019 |
| 1535 | G1930 | DNA | A. thaliana | Predicted polypeptide sequence is paralogous to G867, G9, G993; orthologous to G3388, G3389, G3390, G3391, G3432, G3433, G3451, G3452, G3453, G3454, G3455 |
| 1536 | G1930 | PRT | A. thaliana | Paralogous to G867, G9, G993; Orthologous to G3388, G3389, G3390, G3391, G3432, G3433, G3451, G3452, G3453, G3454, G3455 |
| 1537 | G1942 | DNA | A. thaliana | Predicted polypeptide sequence is paralogous to G2144 |
| 1538 | G1942 | PRT | A. thaliana | Paralogous to G2144 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1539 | G197 | DNA | A. thaliana | Predicted polypeptide sequence is paralogous to G255, G664; orthologous to G3503, G3504, G3505, G3506, G3507, G3508, G3509, G3529, G3531, G3532, G3533, G3534, G3527, G3528, G4637, G4638, G4639, G4640 |
| 1540 | G197 | PRT | A. thaliana | Paralogous to G255, G664; Orthologous to G3503, G3504, G3505, G3506, G3507, G3508, G3509, G3529, G3531, G3532, G3533, G3534, G3527, G3528, G4637, G4638, G4639, G4640 |
| 1541 | G1974 | DNA | A. thaliana | Predicted polypeptide sequence is paralogous to G1889, G2839, G353, G354 |
| 1542 | G1974 | PRT | A. thaliana | Paralogous to G1889, G2839, G353, G354 |
| 1543 | G1986 | DNA | A. thaliana | Predicted polypeptide sequence is paralogous to G1987 |
| 1544 | G1986 | PRT | A. thaliana | Paralogous to G1987 |
| 1545 | G1995 | DNA | A. thaliana | Predicted polypeptide sequence is paralogous to G2826, G2838, G361, G362, G370 |
| 1546 | G1995 | PRT | A. thaliana | Paralogous to G2826, G2838, G361, G362, G370 |
| 1547 | G2003 | DNA | A. thaliana | Predicted polypeptide sequence is paralogous to G1256 |
| 1548 | G2003 | PRT | A. thaliana | Paralogous to G1256 |
| 1549 | G201 | DNA | A. thaliana | Predicted polypeptide sequence is paralogous to G202, G243 |
| 1550 | G201 | PRT | A. thaliana | Paralogous to G202, G243 |
| 1551 | G2016 | DNA | A. thaliana | Predicted polypeptide sequence is paralogous to G2015, G2017 |
| 1552 | G2016 | PRT | A. thaliana | Paralogous to G2015, G2017 |
| 1553 | G2017 | DNA | A. thaliana | Predicted polypeptide sequence is paralogous to G2015, G2016 |
| 1554 | G2017 | PRT | A. thaliana | Paralogous to G2015, G2016 |
| 1555 | G202 | DNA | A. thaliana | Predicted polypeptide sequence is paralogous to G201, G243 |
| 1556 | G202 | PRT | A. thaliana | Paralogous to G201, G243 |
| 1557 | G2022 | DNA | A. thaliana | Predicted polypeptide sequence is paralogous to G2018 |
| 1558 | G2022 | PRT | A. thaliana | Paralogous to G2018 |
| 1559 | G2023 | DNA | A. thaliana | Predicted polypeptide sequence is paralogous to G2020, G2025 |
| 1560 | G2023 | PRT | A. thaliana | Paralogous to G2020, G2025 |
| 1561 | G2025 | DNA | A. thaliana | Predicted polypeptide sequence is paralogous to G2020, G2023 |
| 1562 | G2025 | PRT | A. thaliana | Paralogous to G2020, G2023 |
| 1563 | G2065 | DNA | A. thaliana | Predicted polypeptide sequence is paralogous to G168, G170 |
| 1564 | G2065 | PRT | A. thaliana | Paralogous to G168, G170 |
| 1565 | G207 | DNA | A. thaliana | Predicted polypeptide sequence is paralogous to G227, G230, G242; orthologous to G4218, G4219, G4220, G4221, G4222, G4223, G4224, G4225, G4226, G4227, G4228, G4229, G4230, G4231, G4232, G4234, G4235, G4236, G4237, G4238 |
| 1566 | G207 | PRT | A. thaliana | Paralogous to G227, G230, G242; Orthologous to G4218, G4219, G4220, G4221, G4222, G4223, G4224, G4225, G4226, G4227, G4228, G4229, G4230, G4231, G4232, G4234, G4235, G4236, G4237, G4238 |
| 1567 | G208 | DNA | A. thaliana | Predicted polypeptide sequence is paralogous to G2006 |
| 1568 | G208 | PRT | A. thaliana | Paralogous to G2006 |
| 1569 | G2106 | DNA | A. thaliana | Predicted polypeptide sequence is paralogous to G2131, G979 |
| 1570 | G2106 | PRT | A. thaliana | Paralogous to G2131, G979 |
| 1571 | G2110 | DNA | A. thaliana | Predicted polypeptide sequence is paralogous to G2574 |
| 1572 | G2110 | PRT | A. thaliana | Paralogous to G2574 |
| 1573 | G2128 | DNA | A. thaliana | Predicted polypeptide sequence is paralogous to G1491 |
| 1574 | G2128 | PRT | A. thaliana | Paralogous to G1491 |
| 1575 | G2131 | DNA | A. thaliana | Predicted polypeptide sequence is paralogous to G2106, G979 |
| 1576 | G2131 | PRT | A. thaliana | Paralogous to G2106, G979 |
| 1577 | G2133 | DNA | A. thaliana | Predicted polypeptide sequence is paralogous to G47; orthologous to G3643, G3644, G3645, G3646, G3647, G3649, G3650, G3651 |
| 1578 | G2133 | PRT | A. thaliana | Paralogous to G47; Orthologous to G3643, G3644, G3645, G3646, G3647, G3649, G3650, G3651 |
| 1579 | G2138 | DNA | A. thaliana | Predicted polypeptide sequence is paralogous to G35 |
| 1580 | G2138 | PRT | A. thaliana | Paralogous to G35 |
| 1581 | G2149 | DNA | A. thaliana | Predicted polypeptide sequence is paralogous to G2766; orthologous to G3763, G3764, G3740, G3741, G3772 |
| 1582 | G2149 | PRT | A. thaliana | Paralogous to G2766; Orthologous to G3763, G3764, G3740, G3741, G3772 |
| 1583 | G2158 | DNA | A. thaliana | Predicted polypeptide sequence is paralogous to G2855 |
| 1584 | G2158 | PRT | A. thaliana | Paralogous to G2855 |
| 1585 | G2159 | DNA | A. thaliana | Predicted polypeptide sequence is paralogous to G2781, G599 |
| 1586 | G2159 | PRT | A. thaliana | Paralogous to G2781, G599 |
| 1587 | G2184 | DNA | A. thaliana | Predicted polypeptide sequence is paralogous to G1456, G1927 |
| 1588 | G2184 | PRT | A. thaliana | Paralogous to G1456, G1927 |
| 1589 | G2216 | DNA | A. thaliana | Predicted polypeptide sequence is paralogous to G2215 |
| 1590 | G2216 | PRT | A. thaliana | Paralogous to G2215 |
| 1591 | G223 | DNA | A. thaliana | Predicted polypeptide sequence is paralogous to G224, G1021, G1466 |
| 1592 | G223 | PRT | A. thaliana | Paralogous to G224, G1021, G1466 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1593 | G224 | DNA | A. thaliana | Predicted polypeptide sequence is paralogous to G1021, G1466, G223 |
| 1594 | G224 | PRT | A. thaliana | Paralogous to G1021, G1466, G223 |
| 1595 | G226 | DNA | A. thaliana | Predicted polypeptide sequence is paralogous to G1816, G225, G2718, G682, G3930; orthologous to G3392, G3393, G3431, G3444, G3445, G3446, G3447, G3448, G3449, G3450 |
| 1596 | G226 | PRT | A. thaliana | Paralogous to G1816, G225, G2718, G682, G3930; Orthologous to G3392, G3393, G3431, G3444, G3445, G3446, G3447, G3448, G3449, G3450 |
| 1597 | G2297 | DNA | A. thaliana | Predicted polypeptide sequence is paralogous to G2062, G2063, G2689 |
| 1598 | G2297 | PRT | A. thaliana | Paralogous to G2062, G2063, G2689 |
| 1599 | G230 | DNA | A. thaliana | Predicted polypeptide sequence is paralogous to G207, G227, G242; orthologous to G4218, G4219, G4220, G4221, G4222, G4223, G4224, G4225, G4226, G4227, G4228, G4229, G4230, G4231, G4232, G4234, G4235, G4236, G4237, G4238 |
| 1600 | G230 | PRT | A. thaliana | Paralogous to G207, G227, G242; Orthologous to G4218, G4219, G4220, G4221, G4222, G4223, G4224, G4225, G4226, G4227, G4228, G4229, G4230, G4231, G4232, G4234, G4235, G4236, G4237, G4238 |
| 1601 | G231 | DNA | A. thaliana | Predicted polypeptide sequence is paralogous to G2007 |
| 1602 | G231 | PRT | A. thaliana | Paralogous to G2007 |
| 1603 | G233 | DNA | A. thaliana | Predicted polypeptide sequence is paralogous to G241; orthologous to G4306, G4307, G4308, G4309, G4310 |
| 1604 | G233 | PRT | A. thaliana | Paralogous to G241; Orthologous to G4306, G4307, G4308, G4309, G4310 |
| 1605 | G234 | DNA | A. thaliana | Predicted polypeptide sequence is paralogous to G232 |
| 1606 | G234 | PRT | A. thaliana | Paralogous to G232 |
| 1607 | G2345 | DNA | A. thaliana | Predicted polypeptide sequence is paralogous to G1364, G481, G482, G485; orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1608 | G2345 | PRT | A. thaliana | Paralogous to G1364, G481, G482, G485; Orthologous to G3394, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1609 | G2379 | DNA | A. thaliana | Predicted polypeptide sequence is paralogous to G2377 |
| 1610 | G2379 | PRT | A. thaliana | Paralogous to G2377 |
| 1611 | G24 | DNA | A. thaliana | Predicted polypeptide sequence is paralogous to G12, G1277, G1379; orthologous to G3656 |
| 1612 | G24 | PRT | A. thaliana | Paralogous to G12, G1277, G1379; Orthologous to G3656 |
| 1613 | G2436 | DNA | A. thaliana | Predicted polypeptide sequence is paralogous to G2443, G328 |
| 1614 | G2436 | PRT | A. thaliana | Paralogous to G2443, G328 |
| 1615 | G2443 | DNA | A. thaliana | Predicted polypeptide sequence is paralogous to G2436, G328 |
| 1616 | G2443 | PRT | A. thaliana | Paralogous to G2436, G328 |
| 1617 | G2456 | DNA | A. thaliana | Predicted polypeptide sequence is paralogous to G2454 |
| 1618 | G2456 | PRT | A. thaliana | Paralogous to G2454 |
| 1619 | G2459 | DNA | A. thaliana | Predicted polypeptide sequence is paralogous to G2457 |
| 1620 | G2459 | PRT | A. thaliana | Paralogous to G2457 |
| 1621 | G2467 | DNA | A. thaliana | Predicted polypeptide sequence is paralogous to G812 |
| 1622 | G2467 | PRT | A. thaliana | Paralogous to G812 |
| 1623 | G2469 | DNA | A. thaliana | Predicted polypeptide sequence is paralogous to G1293 |
| 1624 | G2469 | PRT | A. thaliana | Paralogous to G1293 |
| 1625 | G2494 | DNA | A. thaliana | Predicted polypeptide sequence is paralogous to G1216 |
| 1626 | G2494 | PRT | A. thaliana | Paralogous to G1216 |
| 1627 | G2512 | DNA | A. thaliana | Predicted polypeptide sequence is paralogous to G1752 |
| 1628 | G2512 | PRT | A. thaliana | Paralogous to G1752 |
| 1629 | G2513 | DNA | A. thaliana | Predicted polypeptide sequence is paralogous to G40, G2107, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 1630 | G2513 | PRT | A. thaliana | Paralogous to G40, G2107, G41, G42, G912; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 1631 | G2514 | DNA | A. thaliana | Predicted polypeptide sequence is paralogous to G913, G976, G1753 |
| 1632 | G2514 | PRT | A. thaliana | Paralogous to G913, G976, G1753 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1633 | G2534 | DNA | A. thaliana | Predicted polypeptide sequence is paralogous to G1354, G1355, G1453, G1766, G522, G761 |
| 1634 | G2534 | PRT | A. thaliana | Paralogous to G1354, G1355, G1453, G1766, G522, G761 |
| 1635 | G2545 | DNA | A. thaliana | Predicted polypeptide sequence is paralogous to G425, G426, G427 |
| 1636 | G2545 | PRT | A. thaliana | Paralogous to G425, G426, G427 |
| 1637 | G2548 | DNA | A. thaliana | Predicted polypeptide sequence is paralogous to G411 |
| 1638 | G2548 | PRT | A. thaliana | Paralogous to G411 |
| 1639 | G256 | DNA | A. thaliana | Predicted polypeptide sequence is paralogous to G666, G668, G932; orthologous to G3384, G3385, G3386, G3500, G3501, G3502, G3537, G3538, G3539, G3540, G3541 |
| 1640 | G256 | PRT | A. thaliana | Paralogous to G666, G668, G932; Orthologous to G3384, G3385, G3386, G3500, G3501, G3502, G3537, G3538, G3539, G3540, G3541 |
| 1641 | G2572 | DNA | A. thaliana | Predicted polypeptide sequence is paralogous to G1838 |
| 1642 | G2572 | PRT | A. thaliana | Paralogous to G1838 |
| 1643 | G2583 | DNA | A. thaliana | Predicted polypeptide sequence is paralogous to G1387, G975; orthologous to G4294 |
| 1644 | G2583 | PRT | A. thaliana | Paralogous to G1387, G975; Orthologous to G4294 |
| 1645 | G2587 | DNA | A. thaliana | Predicted polypeptide sequence is paralogous to G2586, G2686 |
| 1646 | G2587 | PRT | A. thaliana | Paralogous to G2586, G2686 |
| 1647 | G2588 | DNA | A. thaliana | Predicted polypeptide sequence is paralogous to G1091 |
| 1648 | G2588 | PRT | A. thaliana | Paralogous to G1091 |
| 1649 | G2629 | DNA | A. thaliana | Predicted polypeptide sequence is paralogous to G1053 |
| 1650 | G2629 | PRT | A. thaliana | Paralogous to G1053 |
| 1651 | G2633 | DNA | A. thaliana | Predicted polypeptide sequence is paralogous to G1768, G2697, G313, G852; orthologous to G3815, G3825 |
| 1652 | G2633 | PRT | A. thaliana | Paralogous to G1768, G2697, G313, G852; Orthologous to G3815, G3825 |
| 1653 | G2635 | DNA | A. thaliana | Predicted polypeptide sequence is paralogous to G2505 |
| 1654 | G2635 | PRT | A. thaliana | Paralogous to G2505 |
| 1655 | G2642 | DNA | A. thaliana | Predicted polypeptide sequence is paralogous to G2639, G2640 |
| 1656 | G2642 | PRT | A. thaliana | Paralogous to G2639, G2640 |
| 1657 | G2689 | DNA | A. thaliana | Predicted polypeptide sequence is paralogous to G2062, G2063, G2297 |
| 1658 | G2689 | PRT | A. thaliana | Paralogous to G2062, G2063, G2297 |
| 1659 | G2698 | DNA | A. thaliana | Predicted polypeptide sequence is paralogous to G2696 |
| 1660 | G2698 | PRT | A. thaliana | Paralogous to G2696 |
| 1661 | G2701 | DNA | A. thaliana | Predicted polypeptide sequence is paralogous to G1638, G2452, G1641, G1634 |
| 1662 | G2701 | PRT | A. thaliana | Paralogous to G1638, G2452, G1641, G1634 |
| 1663 | G2709 | DNA | A. thaliana | Predicted polypeptide sequence is paralogous to G2717, G204 |
| 1664 | G2709 | PRT | A. thaliana | Paralogous to G2717, G204 |
| 1665 | G2717 | DNA | A. thaliana | Predicted polypeptide sequence is paralogous to G204, G2709 |
| 1666 | G2717 | PRT | A. thaliana | Paralogous to G204, G2709 |
| 1667 | G2718 | DNA | A. thaliana | Predicted polypeptide sequence is paralogous to G1816, G225, G226, G682, G3930; orthologous to G3392, G3393, G3431, G3444, G3445, G3446, G3447, G3448, G3449, G3450 |
| 1668 | G2718 | PRT | A. thaliana | Paralogous to G1816, G225, G226, G682, G3930; Orthologous to G3392, G3393, G3431, G3444, G3445, G3446, G3447, G3448, G3449, G3450 |
| 1669 | G2738 | DNA | A. thaliana | Predicted polypeptide sequence is paralogous to G3009, G307, G308, G309; orthologous to G3816, G3817, G3818, G3819 |
| 1670 | G2738 | PRT | A. thaliana | Paralogous to G3009, G307, G308, G309; Orthologous to G3816, G3817, G3818, G3819 |
| 1671 | G2741 | DNA | A. thaliana | Predicted polypeptide sequence is paralogous to G1435; orthologous to G4240, G4241, G4243, G4244, G4245 |
| 1672 | G2741 | PRT | A. thaliana | Paralogous to G1435; Orthologous to G4240, G4241, G4243, G4244, G4245 |
| 1673 | G2767 | DNA | A. thaliana | Predicted polypeptide sequence is paralogous to G1131 |
| 1674 | G2767 | PRT | A. thaliana | Paralogous to G1131 |
| 1675 | G2781 | DNA | A. thaliana | Predicted polypeptide sequence is paralogous to G2159, G599 |
| 1676 | G2781 | PRT | A. thaliana | Paralogous to G2159, G599 |
| 1677 | G2817 | DNA | A. thaliana | Predicted polypeptide sequence is paralogous to G2818 |
| 1678 | G2817 | PRT | A. thaliana | Paralogous to G2818 |
| 1679 | G2827 | DNA | A. thaliana | Predicted polypeptide sequence is paralogous to G352 |
| 1680 | G2827 | PRT | A. thaliana | Paralogous to G352 |
| 1681 | G2834 | DNA | A. thaliana | Predicted polypeptide sequence is paralogous to G2840 |
| 1682 | G2834 | PRT | A. thaliana | Paralogous to G2840 |
| 1683 | G2839 | DNA | A. thaliana | Predicted polypeptide sequence is paralogous to G1889, G1974, G353, G354 |
| 1684 | G2839 | PRT | A. thaliana | Paralogous to G1889, G1974, G353, G354 |
| 1687 | G2859 | DNA | A. thaliana | Predicted polypeptide sequence is paralogous to G2779 |
| 1688 | G2859 | PRT | A. thaliana | Paralogous to G2779 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1689 | G2866 | DNA | A. thaliana | Predicted polypeptide sequence is paralogous to G468 |
| 1690 | G2866 | PRT | A. thaliana | Paralogous to G468 |
| 1691 | G2869 | DNA | A. thaliana | Predicted polypeptide sequence is paralogous to G2870, G2871, G2872, G2873, G934 |
| 1692 | G2869 | PRT | A. thaliana | Paralogous to G2870, G2871, G2872, G2873, G934 |
| 1693 | G2870 | DNA | A. thaliana | Predicted polypeptide sequence is paralogous to G2869, G2871, G2872, G2873, G934 |
| 1694 | G2870 | PRT | A. thaliana | Paralogous to G2869, G2871, G2872, G2873, G934 |
| 1695 | G2871 | DNA | A. thaliana | Predicted polypeptide sequence is paralogous to G2869, G2870, G2872, G2873, G934 |
| 1696 | G2871 | PRT | A. thaliana | Paralogous to G2869, G2870, G2872, G2873, G934 |
| 1697 | G2872 | DNA | A. thaliana | Predicted polypeptide sequence is paralogous to G2869, G2870, G2871, G2873, G934 |
| 1698 | G2872 | PRT | A. thaliana | Paralogous to G2869, G2870, G2871, G2873, G934 |
| 1699 | G2873 | DNA | A. thaliana | Predicted polypeptide sequence is paralogous to G2869, G2870, G2871, G2872, G934 |
| 1700 | G2873 | PRT | A. thaliana | Paralogous to G2869, G2870, G2871, G2872, G934 |
| 1701 | G2888 | DNA | A. thaliana | Predicted polypeptide sequence is paralogous to G1991 |
| 1702 | G2888 | PRT | A. thaliana | Paralogous to G1991 |
| 1703 | G289 | DNA | A. thaliana | Predicted polypeptide sequence is paralogous to G290 |
| 1704 | G289 | PRT | A. thaliana | Paralogous to G290 |
| 1705 | G2895 | DNA | A. thaliana | Predicted polypeptide sequence is paralogous to G2896 |
| 1706 | G2895 | PRT | A. thaliana | Paralogous to G2896 |
| 1707 | G2903 | DNA | A. thaliana | Predicted polypeptide sequence is paralogous to G2902 |
| 1708 | G2903 | PRT | A. thaliana | Paralogous to G2902 |
| 1709 | G291 | DNA | A. thaliana | Predicted polypeptide sequence is paralogous to G1211 |
| 1710 | G291 | PRT | A. thaliana | Paralogous to G1211 |
| 1711 | G2981 | DNA | A. thaliana | Predicted polypeptide sequence is paralogous to G2982 |
| 1712 | G2981 | PRT | A. thaliana | Paralogous to G2982 |
| 1713 | G2988 | DNA | A. thaliana | Predicted polypeptide sequence is paralogous to G1423, G1424 |
| 1714 | G2988 | PRT | A. thaliana | Paralogous to G1423, G1424 |
| 1715 | G2994 | DNA | A. thaliana | Predicted polypeptide sequence is paralogous to G2993 |
| 1716 | G2994 | PRT | A. thaliana | Paralogous to G2993 |
| 1717 | G3027 | DNA | A. thaliana | Predicted polypeptide sequence is paralogous to G1057 |
| 1718 | G3027 | PRT | A. thaliana | Paralogous to G1057 |
| 1719 | G3065 | DNA | A. thaliana | Predicted polypeptide sequence is paralogous to G2965 |
| 1720 | G3065 | PRT | A. thaliana | Paralogous to G2965 |
| 1721 | G307 | DNA | A. thaliana | Predicted polypeptide sequence is paralogous to G2738, G3009, G308, G309; orthologous to G3816, G3817, G3818, G3819 |
| 1722 | G307 | PRT | A. thaliana | Paralogous to G2738, G3009, G308, G309; Orthologous to G3816, G3817, G3818, G3819 |
| 1723 | G3079 | DNA | A. thaliana | Predicted polypeptide sequence is paralogous to G3080 |
| 1724 | G3079 | PRT | A. thaliana | Paralogous to G3080 |
| 1725 | G308 | DNA | A. thaliana | Predicted polypeptide sequence is paralogous to G2738, G3009, G307, G309; orthologous to G3816, G3817, G3818, G3819 |
| 1726 | G308 | PRT | A. thaliana | Paralogous to G2738, G3009, G307, G309; Orthologous to G3816, G3817, G3818, G3819 |
| 1727 | G312 | DNA | A. thaliana | Predicted polypeptide sequence is paralogous to G2739 |
| 1728 | G312 | PRT | A. thaliana | Paralogous to G2739 |
| 1729 | G313 | DNA | A. thaliana | Predicted polypeptide sequence is paralogous to G1768, G2633, G2697, G852; orthologous to G3815, G3825 |
| 1730 | G313 | PRT | A. thaliana | Paralogous to G1768, G2633, G2697, G852; Orthologous to G3815, G3825 |
| 1731 | G314 | DNA | A. thaliana | Predicted polypeptide sequence is paralogous to G2699 |
| 1732 | G314 | PRT | A. thaliana | Paralogous to G2699 |
| 1733 | G3362 | DNA | M. truncatula | Predicted polypeptide sequence is paralogous to G3364, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1734 | G3362 | PRT | M. truncatula | Paralogous to G3364, G3365, G3366, G3367, G3368, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1735 | G3364 | DNA | M. truncatula | Predicted polypeptide sequence is paralogous to G3362, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1736 | G3364 | PRT | *M. truncatula* | Paralogous to G3362, G3365, G3366, G3367, G3368, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1737 | G3365 | DNA | *M. truncatula* | Predicted polypeptide sequence is paralogous to G3362, G3364, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1738 | G3365 | PRT | *M. truncatula* | Paralogous to G3362, G3364, G3366, G3367, G3368, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1739 | G3366 | DNA | *M. truncatula* | Predicted polypeptide sequence is paralogous to G3362, G3364, G3365, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1740 | G3366 | PRT | *M. truncatula* | Paralogous to G3362, G3364, G3365, G3367, G3368, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1741 | G3367 | DNA | *M. truncatula* | Predicted polypeptide sequence is paralogous to G3362, G3364, G3365, G3366, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1742 | G3367 | PRT | *M. truncatula* | Paralogous to G3362, G3364, G3365, G3366, G3368, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1743 | G3368 | DNA | *M. truncatula* | Predicted polypeptide sequence is paralogous to G3362, G3364, G3365, G3366, G3367, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1744 | G3368 | PRT | *M. truncatula* | Paralogous to G3362, G3364, G3365, G3366, G3367, G3369; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1745 | G3369 | DNA | *M. truncatula* | Predicted polypeptide sequence is paralogous to G3362, G3364, G3365, G3366, G3367, G3368; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1746 | G3369 | PRT | *M. truncatula* | Paralogous to G3362, G3364, G3365, G3366, G3367, G3368; Orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3443, G3463, G3464, G3465, G3466, G3467, G3468, G3469 |
| 1747 | G3370 | DNA | *O. sativa* | Predicted polypeptide sequence is paralogous to G3371, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1748 | G3370 | PRT | *O. sativa* | Paralogous to G3371, G3374, G3376, G3378; Orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1749 | G3371 | DNA | *O. sativa* | Predicted polypeptide sequence is paralogous to G3370, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1750 | G3371 | PRT | *O. sativa* | Paralogous to G3370, G3374, G3376, G3378; Orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1751 | G3372 | DNA | *O. sativa* | Predicted polypeptide sequence is paralogous to G3373, G3375, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1752 | G3372 | PRT | *O. sativa* | Paralogous to G3373, G3375, G3377, G3379; Orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1753 | G3373 | DNA | *O. sativa* | Predicted polypeptide sequence is paralogous to G3372, G3375, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1754 | G3373 | PRT | *O. sativa* | Paralogous to G3372, G3375, G3377, G3379; Orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1755 | G3374 | DNA | *O. sativa* | Predicted polypeptide sequence is paralogous to G3370, G3371, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1756 | G3374 | PRT | *O. sativa* | Paralogous to G3370, G3371, G3376, G3378; Orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1757 | G3375 | DNA | *O. sativa* | Predicted polypeptide sequence is paralogous to G3372, G3373, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1758 | G3375 | PRT | *O. sativa* | Paralogous to G3372, G3373, G3377, G3379; Orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1759 | G3376 | DNA | *O. sativa* | Predicted polypeptide sequence is paralogous to G3370, G3371, G3374, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1760 | G3376 | PRT | *O. sativa* | Paralogous to G3370, G3371, G3374, G3378; Orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1761 | G3377 | DNA | *O. sativa* | Predicted polypeptide sequence is paralogous to G3372, G3373, G3375, G3379; orthologous to G40, G2107, G2513, G41, G42, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1762 | G3377 | PRT | O. sativa | Paralogous to G3372, G3373, G3375, G3379; Orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1763 | G3378 | DNA | O. sativa | Predicted polypeptide sequence is paralogous to G3370, G3371, G3374, G3376; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1764 | G3378 | PRT | O. sativa | Paralogous to G3370, G3371, G3374, G3376; Orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3443, G3463, G3464, G3465, G3466, G3467, G3468, G3469 |
| 1765 | G3379 | DNA | O. sativa | Predicted polypeptide sequence is paralogous to G3372, G3373, G3375, G3377; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1766 | G3379 | PRT | O. sativa | Paralogous to G3372, G3373, G3375, G3377; Orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3443, G3463, G3464, G3465, G3466, G3467, G3468, G3469 |
| 1767 | G3380 | DNA | O. sativa | Predicted polypeptide sequence is paralogous to G3381, G3383, G3515, G3737; orthologous to G1791, G1792, G1795, G30, G3516, G3517, G3518, G3519, G3520, G3735, G3736, G3794, G3739, G3929, G4328, G4329, G4330 |
| 1768 | G3380 | PRT | O. sativa | Paralogous to G3381, G3383, G3515, G3737; Orthologous to G1791, G1792, G1795, G30, G3516, G3517, G3518, G3519, G3520, G3735, G3736, G3794, G3739, G3929, G4328, G4329, G4330 |
| 1769 | G3381 | DNA | O. sativa | Predicted polypeptide sequence is paralogous to G3380, G3383, G3515, G3737; orthologous to G1791, G1792, G1795, G30, G3516, G3517, G3518, G3519, G3520, G3735, G3736, G3794, G3739, G3929, G4328, G4329, G4330 |
| 1770 | G3381 | PRT | O. sativa | Paralogous to G3380, G3383, G3515, G3737; Orthologous to G1791, G1792, G1795, G30, G3516, G3517, G3518, G3519, G3520, G3735, G3736, G3794, G3739, G3929, G4328, G4329, G4330 |
| 1771 | G3383 | DNA | O. sativa | Predicted polypeptide sequence is paralogous to G3380, G3381, G3515, G3737; orthologous to G1791, G1792, G1795, G30, G3516, G3517, G3518, G3519, G3520, G3735, G3736, G3794, G3739, G3929, G4328, G4329, G4330 |
| 1772 | G3383 | PRT | O. sativa | Paralogous to G3380, G3381, G3515, G3737; Orthologous to G1791, G1792, G1795, G30, G3516, G3517, G3518, G3519, G3520, G3735, G3736, G3794, G3739, G3929, G4328, G4329, G4330 |
| 1773 | G3384 | DNA | O. sativa | Predicted polypeptide sequence is paralogous to G3385, G3386, G3502; orthologous to G256, G666, G668, G932, G3500, G3501, G3537, G3538, G3539, G3540, G3541 |
| 1774 | G3384 | PRT | O. sativa | Paralogous to G3385, G3386, G3502; Orthologous to G256, G666, G668, G932, G3500, G3501, G3537, G3538, G3539, G3540, G3541 |
| 1775 | G3385 | DNA | O. sativa | Predicted polypeptide sequence is paralogous to G3384, G3386, G3502; orthologous to G256, G666, G668, G932, G3500, G3501, G3537, G3538, G3539, G3540, G3541 |
| 1776 | G3385 | PRT | O. sativa | Paralogous to G3384, G3386, G3502; Orthologous to G256, G666, G668, G932, G3500, G3501, G3537, G3538, G3539, G3540, G3541 |
| 1777 | G3386 | DNA | O. sativa | Predicted polypeptide sequence is paralogous to G3384, G3385, G3502; orthologous to G256, G666, G668, G932, G3500, G3501, G3537, G3538, G3539, G3540, G3541 |
| 1778 | G3386 | PRT | O. sativa | Paralogous to G3384, G3385, G3502; Orthologous to G256, G666, G668, G932, G3500, G3501, G3537, G3538, G3539, G3540, G3541 |
| 1779 | G3388 | DNA | O. sativa | Predicted polypeptide sequence is paralogous to G3389, G3390, G3391; orthologous to G1930, G867, G9, G993, G3432, G3433, G3451, G3452, G3453, G3454, G3455 |
| 1780 | G3388 | PRT | O. sativa | Paralogous to G3389, G3390, G3391; Orthologous to G1930, G867, G9, G993, G3432, G3433, G3451, G3452, G3453, G3454, G3455 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1781 | G3389 | DNA | O. sativa | Predicted polypeptide sequence is paralogous to G3388, G3390, G3391; orthologous to G1930, G867, G9, G993, G3432, G3433, G3451, G3452, G3453, G3454, G3455 |
| 1782 | G3389 | PRT | O. sativa | Paralogous to G3388, G3390, G3391; Orthologous to G1930, G867, G9, G993, G3432, G3433, G3451, G3452, G3453, G3454, G3455 |
| 1783 | G3390 | DNA | O. sativa | Predicted polypeptide sequence is paralogous to G3388, G3389, G3391; orthologous to G1930, G867, G9, G993, G3432, G3433, G3451, G3452, G3453, G3454, G3455 |
| 1784 | G3390 | PRT | O. sativa | Paralogous to G3388, G3389, G3391; Orthologous to G1930, G867, G9, G993, G3432, G3433, G3451, G3452, G3453, G3454, G3455 |
| 1785 | G3391 | DNA | O. sativa | Predicted polypeptide sequence is paralogous to G3388, G3389, G3390; orthologous to G1930, G867, G9, G993, G3432, G3433, G3451, G3452, G3453, G3454, G3455 |
| 1786 | G3391 | PRT | O. sativa | Paralogous to G3388, G3389, G3390; Orthologous to G1930, G867, G9, G993, G3432, G3433, G3451, G3452, G3453, G3454, G3455 |
| 1787 | G3392 | DNA | O. sativa | Predicted polypeptide sequence is paralogous to G3393; orthologous to G1816, G225, G226, G2718, G682, G3431, G3444, G3445, G3446, G3447, G3448, G3449, G3450, G3930 |
| 1788 | G3392 | PRT | O. sativa | Paralogous to G3393; Orthologous to G1816, G225, G226, G2718, G682, G3431, G3444, G3445, G3446, G3447, G3448, G3449, G3450, G3930 |
| 1789 | G3393 | DNA | O. sativa | Predicted polypeptide sequence is paralogous to G3392; orthologous to G1816, G225, G226, G2718, G682, G3431, G3444, G3445, G3446, G3447, G3448, G3449, G3450, G3930 |
| 1790 | G3393 | PRT | O. sativa | Paralogous to G3392; Orthologous to G1816, G225, G226, G2718, G682, G3431, G3444, G3445, G3446, G3447, G3448, G3449, G3450, G3930 |
| 1791 | G3394 | DNA | O. sativa | Predicted polypeptide sequence is orthologous to G1364, G2345, G481, G482, G485, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1792 | G3394 | PRT | O. sativa | Orthologous to G1364, G2345, G481, G482, G485, G3395, G3396, G3397, G3398, G3429, G3434, G3435, G3436, G3437, G3470, G3471, G3472, G3473, G3474, G3475, G3476, G3478, G3866, G3868, G3870, G3873, G3874, G3875, G3876, G3938, G4272, G4276 |
| 1793 | G3395 | DNA | O. sativa | Predicted polypeptide sequence is paralogous to G3396, G3397, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1794 | G3395 | PRT | O. sativa | Paralogous to G3396, G3397, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1795 | G3396 | DNA | O. sativa | Predicted polypeptide sequence is paralogous to G3395, G3397, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1796 | G3396 | PRT | O. sativa | Paralogous to G3395, G3397, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1797 | G3397 | DNA | O. sativa | Predicted polypeptide sequence is paralogous to G3395, G3396, G3398, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1798 | G3397 | PRT | O. sativa | Paralogous to G3395, G3396, G3398, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1799 | G3398 | DNA | O. sativa | Predicted polypeptide sequence is paralogous to G3395, G3396, G3397, G3429, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1800 | G3398 | PRT | O. sativa | Paralogous to G3395, G3396, G3397, G3429, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1801 | G3399 | DNA | O. sativa | Predicted polypeptide sequence is paralogous to G3400; orthologous to G1067, G1073, G2156 |
| 1802 | G3399 | PRT | O. sativa | Paralogous to G3400; Orthologous to G1067, G1073, G2156 |
| 1803 | G3400 | DNA | O. sativa | Predicted polypeptide sequence is paralogous to G3399; orthologous to G1067, G1073, G2156 |
| 1804 | G3400 | PRT | O. sativa | Paralogous to G3399; Orthologous to G1067, G1073, G2156 |
| 1805 | G3406 | DNA | O. sativa | Predicted polypeptide sequence is paralogous to G3407; orthologous to G1075, G1076, G3458, G3459, G3460, G3461 |
| 1806 | G3406 | PRT | O. sativa | Paralogous to G3407; Orthologous to G1075, G1076, G3458, G3459, G3460, G3461 |
| 1807 | G3407 | DNA | O. sativa | Predicted polypeptide sequence is paralogous to G3406; orthologous to G1075, G1076, G3458, G3459, G3460, G3461 |
| 1808 | G3407 | PRT | O. sativa | Paralogous to G3406; Orthologous to G1075, G1076, G3458, G3459, G3460, G3461 |
| 1809 | G3429 | DNA | O. sativa | Predicted polypeptide sequence is paralogous to G3395, G3396, G3397, G3398, G3938; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1810 | G3429 | PRT | O. sativa | Paralogous to G3395, G3396, G3397, G3398, G3938; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 1811 | G3430 | DNA | O. sativa | Predicted polypeptide sequence is paralogous to G3848, G5171; orthologous to G22, G1006, G28, G3659, G3660, G3661, G3717, G3718, G3841, G3843, G3844, G3845, G3846, G3852, G3856, G3857, G3858, G3864, G3865, G4626 |
| 1812 | G3430 | PRT | O. sativa | Paralogous to G3848, G5171; Orthologous to G22, G1006, G28, G3659, G3660, G3661, G3717, G3718, G3841, G3843, G3844, G3845, G3846, G3852, G3856, G3857, G3858, G3864, G3865, G4626 |
| 1813 | G3431 | DNA | Z. mays | Predicted polypeptide sequence is paralogous to G3444; orthologous to G1816, G225, G226, G2718, G682, G3392, G3393, G3445, G3446, G3447, G3448, G3449, G3450, G3930 |
| 1814 | G3431 | PRT | Z. mays | Paralogous to G3444; Orthologous to G1816, G225, G226, G2718, G682, G3392, G3393, G3445, G3446, G3447, G3448, G3449, G3450, G3930 |
| 1815 | G3432 | DNA | Z. mays | Predicted polypeptide sequence is paralogous to G3433; orthologous to G1930, G867, G9, G993, G3388, G3389, G3390, G3391, G3451, G3452, G3453, G3454, G3455 |
| 1816 | G3432 | PRT | Z. mays | Paralogous to G3433; Orthologous to G1930, G867, G9, G993, G3388, G3389, G3390, G3391, G3451, G3452, G3453, G3454, G3455 |
| 1817 | G3433 | DNA | Z. mays | Predicted polypeptide sequence is paralogous to G3432; orthologous to G1930, G867, G9, G993, G3388, G3389, G3390, G3391, G3451, G3452, G3453, G3454, G3455 |
| 1818 | G3433 | PRT | Z. mays | Paralogous to G3432; Orthologous to G1930, G867, G9, G993, G3388, G3389, G3390, G3391, G3451, G3452, G3453, G3454, G3455 |
| 1819 | G3434 | DNA | Z. mays | Predicted polypeptide sequence is paralogous to G3435, G3436, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1820 | G3434 | PRT | Z. mays | Paralogous to G3435, G3436, G3437, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1821 | G3435 | DNA | Z. mays | Predicted polypeptide sequence is paralogous to G3434, G3436, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1822 | G3435 | PRT | Z. mays | Paralogous to G3434, G3436, G3437, G3866, G3876, G4272, G4276; Orthologous to G1364, G2345, G481, G482, G485, G3394, G3395, G3396, G3397, G3398, G3429, G3470, G3471, G3472, G3473, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3474, G3475, G3476, G3478, G3868, G3870, G3873, G3874, G3875, G3938 |
| 1823 | G3436 | DNA | Z. mays | Predicted polypeptide sequence is paralogous to G3434, G3435, G3437, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1824 | G3436 | PRT | Z. mays | Paralogous to G3434, G3435, G3437, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1825 | G3437 | DNA | Z. mays | Predicted polypeptide sequence is paralogous to G3434, G3435, G3436, G3866, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1826 | G3437 | PRT | Z. mays | Paralogous to G3434, G3435, G3436, G3866, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 1827 | G3438 | DNA | Z. mays | Predicted polypeptide sequence is paralogous to G3439, G3440, G3441, G3442, G3443; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1828 | G3438 | PRT | Z. mays | Paralogous to G3439, G3440, G3441, G3442, G3443; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1829 | G3439 | DNA | Z. mays | Predicted polypeptide sequence is paralogous to G3438, G3440, G3441, G3442, G3443; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1830 | G3439 | PRT | Z. mays | Paralogous to G3438, G3440, G3441, G3442, G3443; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1831 | G3440 | DNA | Z. mays | Predicted polypeptide sequence is paralogous to G3438, G3439, G3441, G3442, G3443; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1832 | G3440 | PRT | Z. mays | Paralogous to G3438, G3439, G3441, G3442, G3443; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1833 | G3441 | DNA | Z. mays | Predicted polypeptide sequence is paralogous to G3438, G3439, G3440, G3442, G3443; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1834 | G3441 | PRT | Z. mays | Paralogous to G3438, G3439, G3440, G3442, G3443; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1835 | G3442 | DNA | Z. mays | Predicted polypeptide sequence is paralogous to G3438, G3439, G3440, G3441, G3443; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1836 | G3442 | PRT | Z. mays | Paralogous to G3438, G3439, G3440, G3441, G3443; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1837 | G3443 | DNA | Z. mays | Predicted polypeptide sequence is paralogous to G3438, G3439, G3440, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1838 | G3443 | PRT | Z. mays | Paralogous to G3438, G3439, G3440, G3441, G3442; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 1839 | G3444 | DNA | Z. mays | Predicted polypeptide sequence is paralogous to G3431; orthologous to G1816, G225, G226, G2718, G682, G3392, G3393, G3445, G3446, G3447, G3448, G3449, G3450, G3930 |
| 1840 | G3444 | PRT | Z. mays | Paralogous to G3431; Orthologous to G1816, G225, G226, G2718, G682, G3392, G3393, G3445, G3446, G3447, G3448, G3449, G3450, G3930 |
| 1841 | G3445 | DNA | G. max | Predicted polypeptide sequence is paralogous to G3446, G3447, G3448, G3449, G3450; orthologous to G1816, G225, G226, G2718, G682, G3392, G3393, G3431, G3444, G3930 |
| 1842 | G3445 | PRT | G. max | Paralogous to G3446, G3447, G3448, G3449, G3450; Orthologous to G1816, G225, G226, G2718, G682, G3392, G3393, G3431, G3444, G3930 |
| 1843 | G3446 | DNA | G. max | Predicted polypeptide sequence is paralogous to G3445, G3447, G3448, G3449, G3450; orthologous to G1816, G225, G226, G2718, G682, G3392, G3393, G3431, G3444, G3930 |
| 1844 | G3446 | PRT | G. max | Paralogous to G3445, G3447, G3448, G3449, G3450; Orthologous to G1816, G225, G226, G2718, G682, G3392, G3393, G3431, G3444, G3930 |
| 1845 | G3447 | DNA | G. max | Predicted polypeptide sequence is paralogous to G3445, G3446, G3448, G3449, G3450; orthologous to G1816, G225, G226, G2718, G682, G3392, G3393, G3431, G3444, G3930 |
| 1846 | G3447 | PRT | G. max | Paralogous to G3445, G3446, G3448, G3449, G3450; Orthologous to G1816, G225, G226, G2718, G682, G3392, G3393, G3431, G3444, G3930 |
| 1847 | G3448 | DNA | G. max | Predicted polypeptide sequence is paralogous to G3445, G3446, G3447, G3449, G3450; orthologous to G1816, G225, G226, G2718, G682, G3392, G3393, G3431, G3444, G3930 |
| 1848 | G3448 | PRT | G. max | Paralogous to G3445, G3446, G3447, G3449, G3450; Orthologous to G1816, G225, G226, G2718, G682, G3392, G3393, G3431, G3444, G3930 |
| 1849 | G3449 | DNA | G. max | Predicted polypeptide sequence is paralogous to G3445, G3446, G3447, G3448, G3450; orthologous to G1816, G225, G226, G2718, G682, G3392, G3393, G3431, G3444, G3930 |
| 1850 | G3449 | PRT | G. max | Paralogous to G3445, G3446, G3447, G3448, G3450; Orthologous to G1816, G225, G226, G2718, G682, G3392, G3393, G3431, G3444, G3930 |
| 1851 | G3450 | DNA | G. max | Predicted polypeptide sequence is paralogous to G3445, G3446, G3447, G3448, G3449; orthologous to G1816, G225, G226, G2718, G682, G3392, G3393, G3431, G3444, G3930 |
| 1852 | G3450 | PRT | G. max | Paralogous to G3445, G3446, G3447, G3448, G3449; Orthologous to G1816, G225, G226, G2718, G682, G3392, G3393, G3431, G3444, G3930 |
| 1853 | G3451 | DNA | G. max | Predicted polypeptide sequence is paralogous to G3452, G3453, G3454, G3455; orthologous to G1930, G867, G9, G993, G3388, G3389, G3390, G3391, G3432, G3433 |
| 1854 | G3451 | PRT | G. max | Paralogous to G3452, G3453, G3454, G3455; Orthologous to G1930, G867, G9, G993, G3388, G3389, G3390, G3391, G3432, G3433 |
| 1855 | G3452 | DNA | G. max | Predicted polypeptide sequence is paralogous to G3451, G3453, G3454, G3455; orthologous to G1930, G867, G9, G993, G3388, G3389, G3390, G3391, G3432, G3433 |
| 1856 | G3452 | PRT | G. max | Paralogous to G3451, G3453, G3454, G3455; Orthologous to G1930, G867, G9, G993, G3388, G3389, G3390, G3391, G3432, G3433 |
| 1857 | G3453 | DNA | G. max | Predicted polypeptide sequence is paralogous to G3451, G3452, G3454, G3455; orthologous to G1930, G867, G9, G993, G3388, G3389, G3390, G3391, G3432, G3433 |
| 1858 | G3453 | PRT | G. max | Paralogous to G3451, G3452, G3454, G3455; Orthologous to G1930, G867, G9, G993, G3388, G3389, G3390, G3391, G3432, G3433 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1859 | G3454 | DNA | *G. max* | Predicted polypeptide sequence is paralogous to G3451, G3452, G3453, G3455; orthologous to G1930, G867, G9, G993, G3388, G3389, G3390, G3391, G3432, G3433 |
| 1860 | G3454 | PRT | *G. max* | Paralogous to G3451, G3452, G3453, G3455; Orthologous to G1930, G867, G9, G993, G3388, G3389, G3390, G3391, G3432, G3433 |
| 1861 | G3455 | DNA | *G. max* | Predicted polypeptide sequence is paralogous to G3451, G3452, G3453, G3454; orthologous to G1930, G867, G9, G993, G3388, G3389, G3390, G3391, G3432, G3433 |
| 1862 | G3455 | PRT | *G. max* | Paralogous to G3451, G3452, G3453, G3454; Orthologous to G1930, G867, G9, G993, G3388, G3389, G3390, G3391, G3432, G3433 |
| 1863 | G3457 | DNA | *G. max* | Predicted polypeptide sequence is orthologous to G2789, G596 |
| 1864 | G3457 | PRT | *G. max* | Orthologous to G2789, G596 |
| 1865 | G3458 | DNA | *G. max* | Predicted polypeptide sequence is paralogous to G3459, G3460, G3461; orthologous to G1075, G1076, G3406, G3407 |
| 1866 | G3458 | PRT | *G. max* | Paralogous to G3459, G3460, G3461; Orthologous to G1075, G1076, G3406, G3407 |
| 1867 | G3459 | DNA | *G. max* | Predicted polypeptide sequence is paralogous to G3458, G3460, G3461; orthologous to G1075, G1076, G3406, G3407 |
| 1868 | G3459 | PRT | *G. max* | Paralogous to G3458, G3460, G3461; Orthologous to G1075, G1076, G3406, G3407 |
| 1869 | G3460 | DNA | *G. max* | Predicted polypeptide sequence is paralogous to G3458, G3459, G3461; orthologous to G1075, G1076, G3406, G3407 |
| 1870 | G3460 | PRT | *G. max* | Paralogous to G3458, G3459, G3461; Orthologous to G1075, G1076, G3406, G3407 |
| 1871 | G3461 | DNA | *G. max* | Predicted polypeptide sequence is paralogous to G3458, G3459, G3460; orthologous to G1075, G1076, G3406, G3407 |
| 1872 | G3461 | PRT | *G. max* | Paralogous to G3458, G3459, G3460; Orthologous to G1075, G1076, G3406, G3407 |
| 1873 | G3463 | DNA | *G. max* | Predicted polypeptide sequence is paralogous to G3464, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1874 | G3463 | PRT | *G. max* | Paralogous to G3464, G3465, G3466, G3467, G3468, G3469; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1875 | G3464 | DNA | *G. max* | Predicted polypeptide sequence is paralogous to G3463, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1876 | G3464 | PRT | *G. max* | Paralogous to G3463, G3465, G3466, G3467, G3468, G3469; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1877 | G3465 | DNA | *G. max* | Predicted polypeptide sequence is paralogous to G3463, G3464, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1878 | G3465 | PRT | *G. max* | Paralogous to G3463, G3464, G3466, G3467, G3468, G3469; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1879 | G3466 | DNA | *G. max* | Predicted polypeptide sequence is paralogous to G3463, G3464, G3465, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1880 | G3466 | PRT | *G. max* | Paralogous to G3463, G3464, G3465, G3467, G3468, G3469; Orthologous to G40, G2107, G2513, G41, G42, G912, G3362, G3364, G3365, G3366, G3367, G3368, G3370, G3371, G3372, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3373, G3374, G3375, G3376, G3377, G3378, G3379, G3438, G3439, G3440, G3441, G3442, G3369, G3497, G3498, G3499, G3443 |
| 1881 | G3467 | DNA | *G. max* | Predicted polypeptide sequence is paralogous to G3463, G3464, G3465, G3466, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1882 | G3467 | PRT | *G. max* | Paralogous to G3463, G3464, G3465, G3466, G3468, G3469; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1883 | G3468 | DNA | *G. max* | Predicted polypeptide sequence is paralogous to G3463, G3464, G3465, G3466, G3467, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1884 | G3468 | PRT | *G. max* | Paralogous to G3463, G3464, G3465, G3466, G3467, G3469; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1885 | G3469 | DNA | *G. max* | Predicted polypeptide sequence is paralogous to G3463, G3464, G3465, G3466, G3467, G3468; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1886 | G3469 | PRT | *G. max* | Paralogous to G3463, G3464, G3465, G3466, G3467, G3468; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443 |
| 1887 | G3470 | DNA | *G. max* | Predicted polypeptide sequence is paralogous to G3471, G3472, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1888 | G3470 | PRT | *G. max* | Paralogous to G3471, G3472, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1889 | G3471 | DNA | *G. max* | Predicted polypeptide sequence is paralogous to G3470, G3472, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1890 | G3471 | PRT | *G. max* | Paralogous to G3470, G3472, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1891 | G3472 | DNA | *G. max* | Predicted polypeptide sequence is paralogous to G3470, G3471, G3473, G3474, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1892 | G3472 | PRT | *G. max* | Paralogous to G3470, G3471, G3473, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1893 | G3473 | DNA | *G. max* | Predicted polypeptide sequence is paralogous to G3470, G3471, G3472, G3474, G3475, G3476, G3478, G3873, G3874, G3875; orthologous to G1364, G2345, G481, G482, G485, G3394, G3395, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3396, G3397, G3398, G3429, G3434, G3435, G3436, G3437, G3866, G3868, G3870, G3876, G3938, G4272, G4276 |
| 1894 | G3473 | PRT | G. max | Paralogous to G3470, G3471, G3472, G3474, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1895 | G3474 | DNA | G. max | Predicted polypeptide sequence is paralogous to G3470, G3471, G3472, G3473, G3475, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1896 | G3474 | PRT | G. max | Paralogous to G3470, G3471, G3472, G3473, G3475, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1897 | G3475 | DNA | G. max | Predicted polypeptide sequence is paralogous to G3470, G3471, G3472, G3473, G3474, G3476, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1898 | G3475 | PRT | G. max | Paralogous to G3470, G3471, G3472, G3473, G3474, G3476, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1899 | G3476 | DNA | G. max | Predicted polypeptide sequence is paralogous to G3470, G3471, G3472, G3473, G3474, G3475, G3478, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1900 | G3476 | PRT | G. max | Paralogous to G3470, G3471, G3472, G3473, G3474, G3475, G3478, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1901 | G3478 | DNA | G. max | Predicted polypeptide sequence is paralogous to G3470, G3471, G3472, G3473, G3474, G3475, G3476, G3873, G3874, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1902 | G3478 | PRT | G. max | Paralogous to G3470, G3471, G3472, G3473, G3474, G3475, G3476, G3873, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 1903 | G3479 | DNA | O. sativa | Predicted polypeptide sequence is paralogous to G3480, G3481, G3482, G3483; orthologous to G152, G153, G1760, G860, G3484, G3485, G3487, G3488, G3489, G3980, G3981, G3982 |
| 1904 | G3479 | PRT | O. sativa | Paralogous to G3480, G3481, G3482, G3483; Orthologous to G152, G153, G1760, G860, G3484, G3485, G3487, G3488, G3489, G3980, G3981, G3982 |
| 1905 | G3480 | DNA | O. sativa | Predicted polypeptide sequence is paralogous to G3479, G3481, G3482, G3483; orthologous to G152, G153, G1760, G860, G3484, G3485, G3487, G3488, G3489, G3980, G3981, G3982 |
| 1906 | G3480 | PRT | O. sativa | Paralogous to G3479, G3481, G3482, G3483; Orthologous to G152, G153, G1760, G860, G3484, G3485, G3487, G3488, G3489, G3980, G3981, G3982 |
| 1907 | G3481 | DNA | O. sativa | Predicted polypeptide sequence is paralogous to G3479, G3480, G3482, G3483; orthologous to G152, G153, G1760, G860, G3484, G3485, G3487, G3488, G3489, G3980, G3981, G3982 |
| 1908 | G3481 | PRT | O. sativa | Paralogous to G3479, G3480, G3482, G3483; Orthologous to G152, G153, G1760, G860, G3484, G3485, G3487, G3488, G3489, G3980, G3981, G3982 |
| 1909 | G3482 | DNA | O. sativa | Predicted polypeptide sequence is paralogous to G3479, G3480, G3481, G3483; orthologous to G152, G153, G1760, G860, G3484, G3485, G3487, G3488, G3489, G3980, G3981, G3982 |
| 1910 | G3482 | PRT | O. sativa | Paralogous to G3479, G3480, G3481, G3483; Orthologous to G152, G153, G1760, G860, G3484, G3485, G3487, G3488, G3489, G3980, G3981, G3982 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1911 | G3483 | DNA | *O. sativa* | Predicted polypeptide sequence is paralogous to G3479, G3480, G3481, G3482; orthologous to G152, G153, G1760, G860, G3484, G3485, G3487, G3488, G3489, G3980, G3981, G3982 |
| 1912 | G3483 | PRT | *O. sativa* | Paralogous to G3479, G3480, G3481, G3482; Orthologous to G152, G153, G1760, G860, G3484, G3485, G3487, G3488, G3489, G3980, G3981, G3982 |
| 1913 | G3484 | DNA | *G. max* | Predicted polypeptide sequence is paralogous to G3485, G3980, G3981; orthologous to G152, G153, G1760, G860, G3479, G3480, G3481, G3482, G3483, G3487, G3488, G3489, G3982 |
| 1914 | G3484 | PRT | *G. max* | Paralogous to G3485, G3980, G3981; Orthologous to G152, G153, G1760, G860, G3479, G3480, G3481, G3482, G3483, G3487, G3488, G3489, G3982 |
| 1915 | G3485 | DNA | *G. max* | Predicted polypeptide sequence is paralogous to G3484, G3980, G3981; orthologous to G152, G153, G1760, G860, G3479, G3480, G3481, G3482, G3483, G3487, G3488, G3489, G3982 |
| 1916 | G3485 | PRT | *G. max* | Paralogous to G3484, G3980, G3981; Orthologous to G152, G153, G1760, G860, G3479, G3480, G3481, G3482, G3483, G3487, G3488, G3489, G3982 |
| 1917 | G3487 | DNA | *Z. mays* | Predicted polypeptide sequence is paralogous to G3488, G3489; orthologous to G152, G153, G1760, G860, G3479, G3480, G3481, G3482, G3483, G3484, G3485, G3980, G3981, G3982 |
| 1918 | G3487 | PRT | *Z. mays* | Paralogous to G3488, G3489; Orthologous to G152, G153, G1760, G860, G3479, G3480, G3481, G3482, G3483, G3484, G3485, G3980, G3981, G3982 |
| 1919 | G3488 | DNA | *Z. mays* | Predicted polypeptide sequence is paralogous to G3487, G3489; orthologous to G152, G153, G1760, G860, G3479, G3480, G3481, G3482, G3483, G3484, G3485, G3980, G3981, G3982 |
| 1920 | G3488 | PRT | *Z. mays* | Paralogous to G3487, G3489; Orthologous to G152, G153, G1760, G860, G3479, G3480, G3481, G3482, G3483, G3484, G3485, G3980, G3981, G3982 |
| 1921 | G3489 | DNA | *Z. mays* | Predicted polypeptide sequence is paralogous to G3487, G3488; orthologous to G152, G153, G1760, G860, G3479, G3480, G3481, G3482, G3483, G3484, G3485, G3980, G3981, G3982 |
| 1922 | G3489 | PRT | *Z. mays* | Paralogous to G3487, G3488; Orthologous to G152, G153, G1760, G860, G3479, G3480, G3481, G3482, G3483, G3484, G3485, G3980, G3981, G3982 |
| 1923 | G3490 | DNA | *Z. mays* | Predicted polypeptide sequence is paralogous to G4369, G4370; orthologous to G1543, G3510, G3524, G4371 |
| 1924 | G3490 | PRT | *Z. mays* | Paralogous to G4369, G4370; Orthologous to G1543, G3510, G3524, G4371 |
| 1925 | G3491 | DNA | *O. sativa* | Predicted polypeptide sequence is orthologous to G807, G810, G3494, G3495, G3512 |
| 1926 | G3491 | PRT | *O. sativa* | Orthologous to G807, G810, G3494, G3495, G3512 |
| 1927 | G3494 | DNA | *G. max* | Predicted polypeptide sequence is paralogous to G3495, G3512; orthologous to G807, G810, G3491 |
| 1928 | G3494 | PRT | *G. max* | Paralogous to G3495, G3512; Orthologous to G807, G810, G3491 |
| 1929 | G3495 | DNA | *G. max* | Predicted polypeptide sequence is paralogous to G3494, G3512; orthologous to G807, G810, G3491 |
| 1930 | G3495 | PRT | *G. max* | Paralogous to G3494, G3512; Orthologous to G807, G810, G3491 |
| 1931 | G3497 | DNA | *M. sativa* | Predicted polypeptide sequence is paralogous to G3498, G3499; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1932 | G3497 | PRT | *M. sativa* | Paralogous to G3498, G3499; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1933 | G3498 | DNA | *M. sativa* | Predicted polypeptide sequence is paralogous to G3497, G3499; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1934 | G3498 | PRT | *M. sativa* | Paralogous to G3497, G3499; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1935 | G3499 | DNA | *M. sativa* | Predicted polypeptide sequence is paralogous to G3497, G3498; orthologous to G40, G2107, G2513, G41, G42, G912, G3362, G3364, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1936 | G3499 | PRT | *M. sativa* | Paralogous to G3497, G3498; Orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3443, G3463, G3464, G3465, G3466, G3467, G3468, G3469 |
| 1937 | G3500 | DNA | *S. lycopersicum* | Predicted polypeptide sequence is paralogous to G3501; orthologous to G256, G666, G668, G932, G3384, G3385, G3386, G3502, G3537, G3538, G3539, G3540, G3541 |
| 1938 | G3500 | PRT | *S. lycopersicum* | Paralogous to G3501; Orthologous to G256, G666, G668, G932, G3384, G3385, G3386, G3502, G3537, G3538, G3539, G3540, G3541 |
| 1939 | G3501 | DNA | *S. lycopersicum* | Predicted polypeptide sequence is paralogous to G3500; orthologous to G256, G666, G668, G932, G3384, G3385, G3386, G3502, G3537, G3538, G3539, G3540, G3541 |
| 1940 | G3501 | PRT | *S. lycopersicum* | Paralogous to G3500; Orthologous to G256, G666, G668, G932, G3384, G3385, G3386, G3502, G3537, G3538, G3539, G3540, G3541 |
| 1941 | G3502 | DNA | *O. sativa* | Predicted polypeptide sequence is paralogous to G3384, G3385, G3386; orthologous to G256, G666, G668, G932, G3500, G3501, G3537, G3538, G3539, G3540, G3541 |
| 1942 | G3502 | PRT | *O. sativa* | Paralogous to G3384, G3385, G3386; Orthologous to G256, G666, G668, G932, G3500, G3501, G3537, G3538, G3539, G3540, G3541 |
| 1943 | G3503 | DNA | *O. sativa* | Predicted polypeptide sequence is paralogous to G3504, G3505, G3506, G3507, G3508; orthologous to G197, G255, G664, G3509, G3529, G3531, G3532, G3533, G3534, G3527, G3528, G4637, G4638, G4639, G4640 |
| 1944 | G3503 | PRT | *O. sativa* | Paralogous to G3504, G3505, G3506, G3507, G3508; Orthologous to G197, G255, G664, G3509, G3529, G3531, G3532, G3533, G3534, G3527, G3528, G4637, G4638, G4639, G4640 |
| 1945 | G3504 | DNA | *O. sativa* | Predicted polypeptide sequence is paralogous to G3503, G3505, G3506, G3507, G3508; orthologous to G197, G255, G664, G3509, G3529, G3531, G3532, G3533, G3534, G3527, G3528, G4637, G4638, G4639, G4640 |
| 1946 | G3504 | PRT | *O. sativa* | Paralogous to G3503, G3505, G3506, G3507, G3508; Orthologous to G197, G255, G664, G3509, G3529, G3531, G3532, G3533, G3534, G3527, G3528, G4637, G4638, G4639, G4640 |
| 1947 | G3505 | DNA | *O. sativa* | Predicted polypeptide sequence is paralogous to G3503, G3504, G3506, G3507, G3508; orthologous to G197, G255, G664, G3509, G3529, G3531, G3532, G3533, G3534, G3527, G3528, G4637, G4638, G4639, G4640 |
| 1948 | G3505 | PRT | *O. sativa* | Paralogous to G3503, G3504, G3506, G3507, G3508; Orthologous to G197, G255, G664, G3509, G3529, G3531, G3532, G3533, G3534, G3527, G3528, G4637, G4638, G4639, G4640 |
| 1949 | G3506 | DNA | *O. saliva* | Predicted polypeptide sequence is paralogous to G3503, G3504, G3505, G3507, G3508; orthologous to G197, G255, G664, G3509, G3529, G3531, G3532, G3533, G3534, G3527, G3528, G4637, G4638, G4639, G4640 |
| 1950 | G3506 | PRT | *O. salita* | Paralogous to G3503, G3504, G3505, G3507, G3508; Orthologous to G197, G255, G664, G3509, G3529, G3531, G3532, G3533, G3534, G3527, G3528, G4637, G4638, G4639, G4640 |
| 1951 | G3507 | DNA | *O. saliva* | Predicted polypeptide sequence is paralogous to G3503, G3504, G3505, G3506, G3508; orthologous to G197, G255, G664, G3509, G3529, G3531, G3532, G3533, G3534, G3527, G3528, G4637, G4638, G4639, G4640 |
| 1952 | G3507 | PRT | *O. saliva* | Paralogous to G3503, G3504, G3505, G3506, G3508; Orthologous to G197, G255, G664, G3509, G3529, G3531, G3532, G3533, G3534, G3527, G3528, G4637, G4638, G4639, G4640 |
| 1953 | G3508 | DNA | *O. saliva* | Predicted polypeptide sequence is paralogous to G3503, G3504, G3505, G3506. G3507; orthologous to G197, G255, G664, G3509, G3529, G3531, G3532, G3533, G3534, G3527, G3528, G4637, G4638, G4639, G4640 |
| 1954 | G3508 | PRT | *O. saliva* | Paralogous to G3503, G3504, G3505, G3506, G3507; Orthologous to G197, G255, G664, G3509, G3529, G3531, G3532, G3533, G3534, G3527, G3528, G4637, G4638, G4639, G4640 |
| 1955 | G3509 | DNA | *S. lycopersicum* | Predicted polypeptide sequence is orthologous to G197, G255, G664, G3503, G3504, G3505, G3506, G3507, G3508, G3529, G3531, G3532, G3533, G3534, G3527, G3528, G4637, G4638, G4639, G4640 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1956 | G3509 | PRT | S. lycopersicum | Orthologous to G197, G255, G664, G3503, G3504, G3505, G3506, G3507, G3508, G3529, G3531, G3532, G3533, G3534, G3527, G3528, G4637, G4638, G4639, G4640 |
| 1957 | G3510 | DNA | O. saliva | Predicted polypeptide sequence is orthologous to G1543, G3490, G3524, G4369, G4370, G4371 |
| 1958 | G3510 | PRT | O saliva | Orthologous to G1543, G3490, G3524, G4369, G4370, G4371 |
| 1959 | G3512 | DNA | G. max | Predicted polypeptide sequence is paralogous to G3494, G3495; orthologous to G807, G810, G3491 |
| 1960 | G3512 | PRT | Z. mays | Paralogous to G3494, G3495; Orthologous to G807, G810, G3491 |
| 1961 | G3515 | DNA | O. saliva | Predicted polypeptide sequence is paralogous to G3380, G3381, G3383, G3737; orthologous to G1791, G1792, G1795, G30, G3516, G3517, G3518, G3519, G3520, G3735, G3736, G3794, G3739, G3929, G4328, G4329, G4330 |
| 1962 | G3515 | PRT | O. saliva | Paralogous to G3380, G3381, G3383, G3737; Orthologous to G1791, G1792, G1795, G30, G3516, G3517, G3518, G3519, G3520, G3735, G3736, G3794, G3739, G3929, G4328, G4329, G4330 |
| 1963 | G3516 | DNA | Z. mays | Predicted polypeptide sequence is paralogous to G3517, G3794, G3739, G3929; orthologous to G1791, G1792, G1795, G30, G3380, G3381, G3383, G3515, G3518, G3519, G3520, G3735, G3736, G3737, G4328, G4329, G4330 |
| 1964 | G3516 | PRT | Z. mays | Paralogous to G3517, G3794, G3739, G3929; Orthologous to G1791, G1792, G1795, G30, G3380, G3381, G3383, G3515, G3518, G3519, G3520, G3735, G3736, G3737, G4328, G4329, G4330 |
| 1965 | G3517 | DNA | Z. mays | Predicted polypeptide sequence is paralogous to G3516, G3794, G3739, G3929; orthologous to G1791, G1792, G1795, G30, G3380, G3381, G3383, G3515, G3518, G3519, G3520, G3735, G3736, G3737, G4328, G4329, G4330 |
| 1966 | G3517 | PRT | Z. mays | Paralogous to G3516, G3794, G3739, G3929; Orthologous to G1791, G1792, G1795, G30, G3380, G3381, G3383, G3515, G3518, G3519, G3520, G3735, G3736, G3737, G4328, G4329, G4330 |
| 1967 | G3518 | DNA | G. max | Predicted polypeptide sequence is paralogous to G3519, G3520; orthologous to G1791, G1792, G1795, G30, G3380, G3381, G3383, G3515, G3516, G3517, G3735, G3736, G3737, G3794, G3739, G3929, G4328, G4329, G4330 |
| 1968 | G3518 | PRT | G. max | Paralogous to G3519, G3520; Orthologous to G1791, G1792, G1795, G30, G3380, G3381, G3383, G3515, G3516, G3517, G3735, G3736, G3737, G3794, G3739, G3929, G4328, G4329, G4330 |
| 1969 | G3519 | DNA | G. max | Predicted polypeptide sequence is paralogous to G3518, G3520; orthologous to G1791, G1792, G1795, G30, G3380, G3381, G3383, G3515, G3516, G3517, G3735, G3736, G3737, G3794, G3739, G3929, G4328, G4329, G4330 |
| 1970 | G3519 | PRT | G. max | Paralogous to G3518, G3520; Orthologous to G1791, G1792, G1795, G30, G3380, G3381, G3383, G3515, G3516, G3517, G3735, G3736, G3737, G3794, G3739, G3929, G4328, G4329, G4330 |
| 1971 | G3520 | DNA | G. max | Predicted polypeptide sequence is paralogous to G3518, G3519; orthologous to G1791, G1792, G1795, G30, G3380, G3381, G3383, G3515, G3516, G3517, G3735, G3736, G3737, G3794, G3739, G3929, G4328, G4329, G4330 |
| 1972 | G3520 | PRT | G. max | Paralogous to G3518, G3519; Orthologous to G1791, G1792, G1795, G30, G3380, G3381, G3383, G3515, G3516, G3517, G3735, G3736, G3737, G3794, G3739, G3929, G4328, G4329, G4330 |
| 1973 | G3524 | DNA | G. max | Predicted polypeptide sequence is paralogous to G4371; orthologous to G1543, G3510, G3490, G4369, G4370 |
| 1974 | G3524 | PRT | G. max | Paralogous to G4371; Orthologous to G1543, G3510, G3490, G4369, G4370 |
| 1975 | G3527 | DNA | G. max | Predicted polypeptide sequence is paralogous to G3529, G3528, G4639; orthologous to G197, G255, G664, G3503, G3504, G3505, G3506, G3507, G3508, G3509, G3531, G3532, G3533, G3534, G4637, G4638, G4640 |
| 1976 | G3527 | PRT | G. max | Paralogous to G3529, G3528, G4639; Orthologous to G197, G255, G664, G3503, G3504, G3505, G3506, G3507, G3508, G3509, G3531, G3532, G3533, G3534, G4637, G4638, G4640 |
| 1977 | G3528 | DNA | G. max | Predicted polypeptide sequence is paralogous to G3529, G3527, G4639; orthologous to G197, G255, G664, G3503, G3504, G3505, G3506, G3507, G3508, G3509, G3531, G3532, G3533, G3534, G4637, G4638, G4640 |
| 1978 | G3528 | PRT | G. max | Paralogous to G3529, G3527, G4639; Orthologous to G197, G255, G664, G3503, G3504, G3505, G3506, G3507, G3508, G3509, G3531, G3532, G3533, G3534, G4637, G4638, G4640 |
| 1979 | G3529 | DNA | G. max | Predicted polypeptide sequence is paralogous to G3527, G3528, G4639; orthologous to G197, G255, G664, G3503, G3504, G3505, G3506, G3507, G3508, G3509, G3531, G3532, G3533, G3534, G4637, G4638, G4640 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 1980 | G3529 | PRT | *G. max* | Paralogous to G3527, G3528, G4639; Orthologous to G197, G255, G664, G3503, G3504, G3505, G3506, G3507, G3508, G3509, G3531, G3532, G3533, G3534, G4637, G4638, G4640 |
| 1981 | G353 | DNA | *A. thaliana* | Predicted polypeptide sequence is paralogous to G1889, G1974, G2839, G354 |
| 1982 | G353 | PRT | *A. thaliana* | Paralogous to G1889, G1974, G2839, G354 |
| 1983 | G3531 | DNA | *Z. mays* | Predicted polypeptide sequence is paralogous to G3532, G3533, G3534, G4637, G4638, G4640; orthologous to G197, G255, G664, G3503, G3504, G3505, G3506, G3507, G3508, G3509, G3529, G3527, G3528, G4639 |
| 1984 | G3531 | PRT | *Z. mays* | Paralogous to G3532, G3533, G3534, G4637, G4638, G4640; Orthologous to G197, G255, G664, G3503, G3504, G3505, G3506, G3507, G3508, G3509, G3529, G3527, G3528, G4639 |
| 1985 | G3532 | DNA | *Z. mays* | Predicted polypeptide sequence is paralogous to G3531, G3533, G3534, G4637, G4638, G4640; orthologous to G197, G255, G664, G3503, G3504, G3505, G3506, G3507, G3508, G3509, G3529, G3527, G3528, G4639 |
| 1986 | G3532 | PRT | *Z. mays* | Paralogous to G3531, G3533, G3534, G4637, G4638, G4640; Orthologous to G197, G255, G664, G3503, G3504, G3505, G3506, G3507, G3508, G3509, G3529, G3527, G3528, G4639 |
| 1987 | G3533 | DNA | *Z. mays* | Predicted polypeptide sequence is paralogous to G3531, G3532, G3534, G4637, G4638, G4640; orthologous to G197, G255, G664, G3503, G3504, G3505, G3506, G3507, G3508, G3509, G3529, G3527, G3528, G4639 |
| 1988 | G3533 | PRT | *Z. mays* | Paralogous to G3531, G3532, G3534, G4637, G4638, G4640; Orthologous to G197, G255, G664, G3503, G3504, G3505, G3506, G3507, G3508, G3509, G3529, G3527, G3528, G4639 |
| 1989 | G3534 | DNA | *Z. mays* | Predicted polypeptide sequence is paralogous to G3531, G3532, G3533, G4637, G4638, G4640; orthologous to G197, G255, G664, G3503, G3504, G3505, G3506, G3507, G3508, G3509, G3529, G3527, G3528, G4639 |
| 1990 | G3534 | PRT | *Z. mays* | Paralogous to G3531, G3532, G3533, G4637, G4638, G4640; Orthologous to G197, G255, G664, G3503, G3504, G3505, G3506, G3507, G3508, G3509, G3529, G3527, G3528, G4639 |
| 1991 | G3537 | DNA | *G. max* | Predicted polypeptide sequence is paralogous to G3538, G3539; orthologous to G256, G666, G668, G932, G3384, G3385, G3386, G3500, G3501, G3502, G3540, G3541 |
| 1992 | G3537 | PRT | *G. max* | Paralogous to G3538, G3539; Orthologous to G256, G666, G668, G932, G3384, G3385, G3386, G3500, G3501, G3502, G3540, G3541 |
| 1993 | G3538 | DNA | *G. max* | Predicted polypeptide sequence is paralogous to G3537, G3539; orthologous to G256, G666, G668, G932, G3384, G3385, G3386, G3500, G3501, G3502, G3540, G3541 |
| 1994 | G3538 | PRT | *G. max* | Paralogous to G3537, G3539; Orthologous to G256, G666, G668, G932, G3384, G3385, G3386, G3500, G3501, G3502, G3540, G3541 |
| 1995 | G3539 | DNA | *G. max* | Predicted polypeptide sequence is paralogous to G3537, G3538; orthologous to G256, G666, G668, G932, G3384, G3385, G3386, G3500, G3501, G3502, G3540, G3541 |
| 1996 | G3539 | PRT | *G. max* | Paralogous to G3537, G3538; Orthologous to G256, G666, G668, G932, G3384, G3385, G3386, G3500, G3501, G3502, G3540, G3541 |
| 1997 | G3540 | DNA | *Z. mays* | Predicted polypeptide sequence is paralogous to G3541; orthologous to G256, G666, G668, G932, G3384, G3385, G3386, G3500, G3501, G3502, G3537, G3538, G3539 |
| 1998 | G3540 | PRT | *Z. mays* | Paralogous to G3541; Orthologous to G256, G666, G668, G932, G3384, G3385, G3386, G3500, G3501, G3502, G3537, G3538, G3539 |
| 1999 | G3541 | DNA | *Z. mays* | Predicted polypeptide sequence is paralogous to G3540; orthologous to G256, G666, G668, G932, G3384, G3385, G3386, G3500, G3501, G3502, G3537, G3538, G3539 |
| 2000 | G3541 | PRT | *Z. mays* | Paralogous to G3540; Orthologous to G256, G666, G668, G932, G3384, G3385, G3386, G3500, G3501, G3502, G3537, G3538, G3539 |
| 2001 | G3542 | DNA | *O. sativa* | Predicted polypeptide sequence is paralogous to G3544, G3545; orthologous to G489, G714, G3547, G3549, G3550, G3551, G3552, G3553, G3554, G3555, G3867, G3892, G3893, G3894, G3896, G4257, G4256 |
| 2002 | G3542 | PRT | *O. sativa* | Paralogous to G3544, G3545; Orthologous to G489, G714, G3547, G3549, G3550, G3551, G3552, G3553, G3554, G3555, G3867, G3892, G3893, G3894, G3896, G4257, G4256 |
| 2003 | G3543 | DNA | *O. sativa* | Predicted polypeptide sequence is orthologous to G1646, G715, G3883, G3884, G3885, G3886, G3889, G4259 |
| 2004 | G3543 | PRT | *O. sativa* | Orthologous to G1646, G715, G3883, G3884, G3885, G3886, G3889, G4259 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2005 | G3544 | DNA | O. sativa | Predicted polypeptide sequence is paralogous to G3542, G3545; orthologous to G489, G714, G3547, G3549, G3550, G3551, G3552, G3553, G3554, G3555, G3867, G3892, G3893, G3894, G3896, G4257, G4256 |
| 2006 | G3544 | PRT | O. sativa | Paralogous to G3542, G3545; Orthologous to G489, G714, G3547, G3549, G3550, G3551, G3552, G3553, G3554, G3555, G3867, G3892, G3893, G3894, G3896, G4257, G4256 |
| 2007 | G3545 | DNA | O. sativa | Predicted polypeptide sequence is paralogous to G3542, G3544; orthologous to G489, G714, G3547, G3549, G3550, G3551, G3552, G3553, G3554, G3555, G3867, G3892, G3893, G3894, G3896, G4257, G4256 |
| 2008 | G3545 | PRT | O. sativa | Paralogous to G3542, G3544; Orthologous to G489, G714, G3547, G3549, G3550, G3551, G3552, G3553, G3554, G3555, G3867, G3892, G3893, G3894, G3896, G4257, G4256 |
| 2009 | G3547 | DNA | G. max | Predicted polypeptide sequence is paralogous to G3549, G3550; orthologous to G489, G714, G3542, G3544, G3545, G3551, G3552, G3553, G3554, G3555, G3867, G3892, G3893, G3894, G3896, G4257, G4256 |
| 2010 | G3547 | PRT | G. max | Paralogous to G3549, G3550; Orthologous to G489, G714, G3542, G3544, G3545, G3551, G3552, G3553, G3554, G3555, G3867, G3892, G3893, G3894, G3896, G4257, G4256 |
| 2011 | G3549 | DNA | G. max | Predicted polypeptide sequence is paralogous to G3547, G3550; orthologous to G489, G714, G3542, G3544, G3545, G3551, G3552, G3553, G3554, G3555, G3867, G3892, G3893, G3894, G3896, G4257, G4256 |
| 2012 | G3549 | PRT | G. max | Paralogous to G3547, G3550; Orthologous to G489, G714, G3542, G3544, G3545, G3551, G3552, G3553, G3554, G3555, G3867, G3892, G3893, G3894, G3896, G4257, G4256 |
| 2013 | G3550 | DNA | G. max | Predicted polypeptide sequence is paralogous to G3547, G3549; orthologous to G489, G714, G3542, G3544, G3545, G3551, G3552, G3553, G3554, G3555, G3867, G3892, G3893, G3894, G3896, G4257, G4256 |
| 2014 | G3550 | PRT | G. max | Paralogous to G3547, G3549; Orthologous to G489, G714, G3542, G3544, G3545, G3551, G3552, G3553, G3554, G3555, G3867, G3892, G3893, G3894, G3896, G4257, G4256 |
| 2015 | G3551 | DNA | Z. mays | Predicted polypeptide sequence is paralogous to G3552, G4257, G4256; orthologous to G489, G714, G3542, G3544, G3545, G3547, G3549, G3550, G3553, G3554, G3555, G3867, G3892, G3893, G3894, G3896 |
| 2016 | G3551 | PRT | Z. mays | Paralogous to G3552, G4257, G4256; Orthologous to G489, G714, G3542, G3544, G3545, G3547, G3549, G3550, G3553, G3554, G3555, G3867, G3892, G3893, G3894, G3896 |
| 2017 | G3552 | DNA | Z. mays | Predicted polypeptide sequence is paralogous to G3551, G4257, G4256; orthologous to G489, G714, G3542, G3544, G3545, G3547, G3549, G3550, G3553, G3554, G3555, G3867, G3892, G3893, G3894, G3896 |
| 2018 | G3552 | PRT | Z. mays | Paralogous to G3551, G4257, G4256; Orthologous to G489, G714, G3542, G3544, G3545, G3547, G3549, G3550, G3553, G3554, G3555, G3867, G3892, G3893, G3894, G3896 |
| 2019 | G3553 | DNA | S. lycopersicum | Predicted polypeptide sequence is paralogous to G3554, G3555, G3894; orthologous to G489, G714, G3542, G3544, G3545, G3547, G3549, G3550, G3551, G3552, G3867, G3892, G3893, G3896, G4257, G4256 |
| 2020 | G3553 | PRT | S. lycopersicum | Paralogous to G3554, G3555, G3894; Orthologous to G489, G714, G3542, G3544, G3545, G3547, G3549, G3550, G3551, G3552, G3867, G3892, G3893, G3896, G4257, G4256 |
| 2021 | G3554 | DNA | S. lycopersicum | Predicted polypeptide sequence is paralogous to G3553, G3555, G3894; orthologous to G489, G714, G3542, G3544, G3545, G3547, G3549, G3550, G3551, G3552, G3867, G3892, G3893, G3896, G4257, G4256 |
| 2022 | G3554 | PRT | S. lycopersicum | Paralogous to G3553, G3555, G3894; Orthologous to G489, G714, G3542, G3544, G3545, G3547, G3549, G3550, G3551, G3552, G3867, G3892, G3893, G3896, G4257, G4256 |
| 2023 | G3555 | DNA | S. lycopersicum | Predicted polypeptide sequence is paralogous to G3553, G3554, G3894; orthologous to G489, G714, G3542, G3544, G3545, G3547, G3549, G3550, G3551, G3552, G3867, G3892, G3893, G3896, G4257, G4256 |
| 2024 | G3555 | PRT | S. lycopersicum | Paralogous to G3553, G3554, G3894; Orthologous to G489, G714, G3542, G3544, G3545, G3547, G3549, G3550, G3551, G3552, G3867, G3892, G3893, G3896, G4257, G4256 |
| 2025 | G361 | DNA | A. thaliana | Predicted polypeptide sequence is paralogous to G1995, G2826, G2838, G362, G370 |
| 2026 | G361 | PRT | A. thaliana | Paralogous to G1995, G2826, G2838, G362, G370 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2027 | G3643 | DNA | *G. max* | Predicted polypeptide sequence is orthologous to G2133, G47, G3644, G3645, G3646, G3647, G3649, G3650, G3651 |
| 2028 | G3643 | PRT | *G. max* | Orthologous to G2133, G47, G3644, G3645, G3646, G3647, G3649, G3650, G3651 |
| 2029 | G3644 | DNA | *O. sativa* | Predicted polypeptide sequence is paralogous to G3649, G3651; orthologous to G2133, G47, G3643, G3645, G3646, G3647, G3650 |
| 2030 | G3644 | PRT | *O. sativa* | Paralogous to G3649, G3651; Orthologous to G2133, G47, G3643, G3645, G3646, G3647, G3650 |
| 2031 | G3645 | DNA | *B. rapa* subsp. *Pekinensis* | Predicted polypeptide sequence is orthologous to G2133, G47, G3643, G3644, G3646, G3647, G3649, G3650, G3651 |
| 2032 | G3645 | PRT | *B. rapa* subsp. *Pekinensis* | Orthologous to G2133, G47, G3643, G3644, G3646, G3647, G3649, G3650, G3651 |
| 2033 | G3646 | DNA | *B. oleracea* | Predicted polypeptide sequence is orthologous to G2133, G47, G3643, G3644, G3645, G3647, G3649, G3650, G3651 |
| 2034 | G3646 | PRT | *B. oleracea* | Orthologous to G2133, G47, G3643, G3644, G3645, G3647, G3649, G3650, G3651 |
| 2035 | G3647 | DNA | *Z. elegans* | Predicted polypeptide sequence is orthologous to G2133, G47, G3643, G3644, G3645, G3646, G3649, G3650, G3651 |
| 2036 | G3647 | PRT | *Z. elegans* | Orthologous to G2133, G47, G3643, G3644, G3645, G3646, G3649, G3650, G3651 |
| 2037 | G3649 | DNA | *O. sativa* | Predicted polypeptide sequence is paralogous to G3644, G3651; orthologous to G2133, G47, G3643, G3645, G3646, G3647, G3650 |
| 2038 | G3649 | PRT | *O. sativa* | Paralogous to G3644, G3651; Orthologous to G2133, G47, G3643, G3645, G3646, G3647, G3650 |
| 2039 | G3650 | DNA | *Z. mays* | Predicted polypeptide sequence is orthologous to G2133, G47, G3643, G3644, G3645, G3646, G3647, G3649, G3651 |
| 2040 | G3650 | PRT | *Z. mays* | Orthologous to G2133, G47, G3643, G3644, G3645, G3646, G3647, G3649, G3651 |
| 2041 | G3651 | DNA | *O. sativa* | Predicted polypeptide sequence is paralogous to G3644, G3649; orthologous to G2133, G47, G3643, G3645, G3646, G3647, G3650 |
| 2042 | G3651 | PRT | *O. sativa* | Paralogous to G3644, G3649; Orthologous to G2133, G47, G3643, G3645, G3646, G3647, G3650 |
| 2043 | G3656 | DNA | *Z. mays* | Predicted polypeptide sequence is orthologous to G12, G1277, G1379, G24 |
| 2044 | G3656 | PRT | *Z. mays* | Orthologous to G12, G1277, G1379, G24 |
| 2045 | G3659 | DNA | *B. oleracea* | Predicted polypeptide sequence is paralogous to G3660; orthologous to G22, G1006, G28, G3430, G3661, G3717, G3718, G3841, G3843, G3844, G3845, G3846, G3848, G3852, G3856, G3857, G3858, G3864, G3865, G4626, G5171 |
| 2046 | G3659 | PRT | *B. oleracea* | Paralogous to G3660; Orthologous to G22, G1006, G28, G3430, G3661, G3717, G3718, G3841, G3843, G3844, G3845, G3846, G3848, G3852, G3856, G3857, G3858, G3864, G3865, G4626, G5171 |
| 2047 | G3660 | DNA | *B. oleracea* | Predicted polypeptide sequence is paralogous to G3659; orthologous to G22, G1006, G28, G3430, G3661, G3717, G3718, G3841, G3843, G3844, G3845, G3846, G3848, G3852, G3856, G3857, G3858, G3864, G3865, G4626, G5171 |
| 2048 | G3660 | PRT | *B. oleracea* | Paralogous to G3659; Orthologous to G22, G1006, G28, G3430, G3661, G3717, G3718, G3841, G3843, G3844, G3845, G3846, G3848, G3852, G3856, G3857, G3858, G3864, G3865, G4626, G5171 |
| 2049 | G3661 | DNA | *Z. mays* | Predicted polypeptide sequence is paralogous to G3856; orthologous to G22, G1006, G28, G3430, G3659, G3660, G3717, G3718, G3841, G3843, G3844, G3845, G3846, G3848, G3852, G3857, G3858, G3864, G3865, G4626, G5171 |
| 2050 | G3661 | PRT | *Z. mays* | Paralogous to G3856; Orthologous to G22, G1006, G28, G3430, G3659, G3660, G3717, G3718, G3841, G3843, G3844, G3845, G3846, G3848, G3852, G3857, G3858, G3864, G3865, G4626, G5171 |
| 2051 | G3663 | DNA | *L. corniculatus* var. *japonicus* | Predicted polypeptide sequence is orthologous to G2999, G2998 |
| 2052 | G3663 | PRT | *L. corniculatus* var. *japonicus* | Orthologous to G2999, G2998 |
| 2053 | G3680 | DNA | *Z. mays* | Predicted polypeptide sequence is paralogous to G3681; orthologous to G2989, G2990, G3691, G3859, G3860, G3861, G3934 |
| 2054 | G3680 | PRT | *Z. mays* | Paralogous to G3681; Orthologous to G2989, G2990, G3691, G3859, G3860, G3861, G3934 |
| 2055 | G3681 | DNA | *Z. mays* | Predicted polypeptide sequence is paralogous to G3680; orthologous to G2989, G2990, G3691, G3859, G3860, G3861, G3934 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2056 | G3681 | PRT | Z. mays | Paralogous to G3680; Orthologous to G2989, G2990, G3691, G3859, G3860, G3861, G3934 |
| 2057 | G3691 | DNA | O. sativa | Predicted polypeptide sequence is orthologous to G2989, G2990, G3680, G3681, G3859, G3860, G3861, G3934 |
| 2058 | G3691 | PRT | O. sativa | Orthologous to G2989, G2990, G3680, G3681, G3859, G3860, G3861, G3934 |
| 2059 | G370 | DNA | A. thaliana | Predicted polypeptide sequence is paralogous to G1995, G2826, G2838, G361, G362 |
| 2060 | G370 | PRT | A. thaliana | Paralogous to G1995, G2826, G2838, G361, G362 |
| 2061 | G3717 | DNA | G. max | Predicted polypeptide sequence is paralogous to G3718; orthologous to G22, G1006, G28, G3430, G3659, G3660, G3661, G3841, G3843, G3844, G3845, G3846, G3848, G3852, G3856, G3857, G3858, G3864, G3865, G4626, G5171 |
| 2062 | G3717 | PRT | G. max | Paralogous to G3718; Orthologous to G22, G1006, G28, G3430, G3659, G3660, G3661, G3841, G3843, G3844, G3845, G3846, G3848, G3852, G3856, G3857, G3858, G3864, G3865, G4626, G5171 |
| 2063 | G3718 | DNA | G. max | Predicted polypeptide sequence is paralogous to G3717; orthologous to G22, G1006, G28, G3430, G3659, G3660, G3661, G3841, G3843, G3844, G3845, G3846, G3848, G3852, G3856, G3857, G3858, G3864, G3865, G4626, G5171 |
| 2064 | G3718 | PRT | G. max | Paralogous to G3717; Orthologous to G22, G1006, G28, G3430, G3659, G3660, G3661, G3841, G3843, G3844, G3845, G3846, G3848, G3852, G3856, G3857, G3858, G3864, G3865, G4626, G5171 |
| 2065 | G3719 | DNA | Z. mays | Predicted polypeptide sequence is paralogous to G3722, G3720, G3727, G3728, G3804; orthologous to G1274, G3723, G3724, G3731, G3732, G3803, G1275, G3721, G3725, G3726, G3729, G3730, G3733, G3795, G3797, G3802 |
| 2066 | G3719 | PRT | Z. mays | Paralogous to G3722, G3720, G3727, G3728, G3804; Orthologous to G1274, G3723, G3724, G3731, G3732, G3803, G1275, G3721, G3725, G3726, G3729, G3730, G3733, G3795, G3797, G3802 |
| 2067 | G3720 | DNA | Z. mays | Predicted polypeptide sequence is paralogous to G3722, G3719, G3727, G3728, G3804; orthologous to G1274, G3723, G3724, G3731, G3732, G3803, G1275, G3721, G3725, G3726, G3729, G3730, G3733, G3795, G3797, G3802 |
| 2068 | G3720 | PRT | Z. mays | Paralogous to G3722, G3719, G3727, G3728, G3804; Orthologous to G1274, G3723, G3724, G3731, G3732, G3803, G1275, G3721, G3725, G3726, G3729, G3730, G3733, G3795, G3797, G3802 |
| 2069 | G3721 | DNA | O. sativa | Predicted polypeptide sequence is paralogous to G3725, G3726, G3729, G3730; orthologous to G1274, G3722, G3723, G3724, G3731, G3732, G3803, G1275, G3719, G3720, G3727, G3728, G3733, G3795, G3797, G3802, G3804 |
| 2070 | G3721 | PRT | O. sativa | Paralogous to G3725, G3726, G3729, G3730; Orthologous to G1274, G3722, G3723, G3724, G3731, G3732, G3803, G1275, G3719, G3720, G3727, G3728, G3733, G3795, G3797, G3802, G3804 |
| 2071 | G3722 | DNA | Z. mays | Predicted polypeptide sequence is paralogous to G3719, G3720, G3727, G3728, G3804; orthologous to G1274, G3723, G3724, G3731, G3732, G3803, G1275, G3721, G3725, G3726, G3729, G3730, G3733, G3795, G3797, G3802 |
| 2072 | G3722 | PRT | Z. mays | Paralogous to G3719, G3720, G3727, G3728, G3804; Orthologous to G1274, G3723, G3724, G3731, G3732, G3803, G1275, G3721, G3725, G3726, G3729, G3730, G3733, G3795, G3797, G3802 |
| 2073 | G3723 | DNA | G. max | Predicted polypeptide sequence is paralogous to G3724, G3803; orthologous to G1274, G3722, G3731, G3732, G1275, G3719, G3720, G3721, G3725, G3726, G3727, G3728, G3729, G3730, G3733, G3795, G3797, G3802, G3804 |
| 2074 | G3723 | PRT | G. max | Paralogous to G3724, G3803; Orthologous to G1274, G3722, G3731, G3732, G1275, G3719, G3720, G3721, G3725, G3726, G3727, G3728, G3729, G3730, G3733, G3795, G3797, G3802, G3804 |
| 2075 | G3724 | DNA | G. max | Predicted polypeptide sequence is paralogous to G3723, G3803; orthologous to G1274, G3722, G3731, G3732, G1275, G3719, G3720, G3721, G3725, G3726, G3727, G3728, G3729, G3730, G3733, G3795, G3797, G3802, G3804 |
| 2076 | G3724 | PRT | G. max | Paralogous to G3723, G3803; Orthologous to G1274, G3722, G3731, G3732, G1275, G3719, G3720, G3721, G3725, G3726, G3727, G3728, G3729, G3730, G3733, G3795, G3797, G3802, G3804 |
| 2077 | G3725 | DNA | O. sativa | Predicted polypeptide sequence is paralogous to G3721, G3726, G3729, G3730; orthologous to G1274, G3722, G3723, G3724, G3731, G3732, G3803, G1275, G3719, G3720, G3727, G3728, G3733, G3795, G3797, G3802, G3804 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2078 | G3725 | PRT | O. sativa | Paralogous to G3721, G3726, G3729, G3730; Orthologous to G1274, G3722, G3723, G3724, G3731, G3732, G3803, G1275, G3719, G3720, G3727, G3728, G3733, G3795, G3797, G3802, G3804 |
| 2079 | G3726 | DNA | O. sativa | Predicted polypeptide sequence is paralogous to G3721, G3725, G3729, G3730; orthologous to G1274, G3722, G3723, G3724, G3731, G3732, G3803, G1275, G3719, G3720, G3727, G3728, G3733, G3795, G3797, G3802, G3804 |
| 2080 | G3726 | PRT | O. sativa | Paralogous to G3721, G3725, G3729, G3730; Orthologous to G1274, G3722, G3723, G3724, G3731, G3732, G3803, G1275, G3719, G3720, G3727, G3728, G3733, G3795, G3797, G3802, G3804 |
| 2081 | G3727 | DNA | Z. mays | Predicted polypeptide sequence is paralogous to G3722, G3719, G3720, G3728, G3804; orthologous to G1274, G3723, G3724, G3731, G3732, G3803, G1275, G3721, G3725, G3726, G3729, G3730, G3733, G3795, G3797, G3802 |
| 2082 | G3727 | PRT | Z. mays | Paralogous to G3722, G3719, G3720, G3728, G3804; Orthologous to G1274, G3723, G3724, G3731, G3732, G3803, G1275, G3721, G3725, G3726, G3729, G3730, G3733, G3795, G3797, G3802 |
| 2083 | G3728 | DNA | Z. mays | Predicted polypeptide sequence is paralogous to G3722, G3719, G3720, G3727, G3804; orthologous to G1274, G3723, G3724, G3731, G3732, G3803, G1275, G3721, G3725, G3726, G3729, G3730, G3733, G3795, G3797, G3802 |
| 2084 | G3728 | PRT | Z. mays | Paralogous to G3722, G3719, G3720, G3727, G3804; Orthologous to G1274, G3723, G3724, G3731, G3732, G3803, G1275, G3721, G3725, G3726, G3729, G3730, G3733, G3795, G3797, G3802 |
| 2085 | G3729 | DNA | O. sativa | Predicted polypeptide sequence is paralogous to G3721, G3725, G3726, G3730; orthologous to G1274, G3722, G3723, G3724, G3731, G3732, G3803, G1275, G3719, G3720, G3727, G3728, G3733, G3795, G3797, G3802, G3804 |
| 2086 | G3729 | PRT | O. sativa | Paralogous to G3721, G3725, G3726, G3730; Orthologous to G1274, G3722, G3723, G3724, G3731, G3732, G3803, G1275, G3719, G3720, G3727, G3728, G3733, G3795, G3797, G3802, G3804 |
| 2087 | G3730 | DNA | O. sativa | Predicted polypeptide sequence is paralogous to G3721, G3725, G3726, G3729; orthologous to G1274, G3722, G3723, G3724, G3731, G3732, G3803, G1275, G3719, G3720, G3727, G3728, G3733, G3795, G3797, G3802, G3804 |
| 2088 | G3730 | PRT | O. sativa | Paralogous to G3721, G3725, G3726, G3729; Orthologous to G1274, G3722, G3723, G3724, G3731, G3732, G3803, G1275, G3719, G3720, G3727, G3728, G3733, G3795, G3797, G3802, G3804 |
| 2089 | G3731 | DNA | S. lycopersicum | Predicted polypeptide sequence is orthologous to G1274, G3722, G3723, G3724, G3732, G3803, G1275, G3719, G3720, G3721, G3725, G3726, G3727, G3728, G3729, G3730, G3733, G3795, G3797, G3802, G3804 |
| 2090 | G3731 | PRT | S. lycopersicum | Orthologous to G1274, G3722, G3723, G3724, G3732, G3803, G1275, G3719, G3720, G3721, G3725, G3726, G3727, G3728, G3729, G3730, G3733, G3795, G3797, G3802, G3804 |
| 2091 | G3732 | DNA | S. tuberosum | Predicted polypeptide sequence is orthologous to G1274, G3722, G3723, G3724, G3731, G3803, G1275, G3719, G3720, G3721, G3725, G3726, G3727, G3728, G3729, G3730, G3733, G3795, G3797, G3802, G3804 |
| 2092 | G3732 | PRT | S. tuberosum | Orthologous to G1274, G3722, G3723, G3724, G3731, G3803, G1275, G3719, G3720, G3721, G3725, G3726, G3727, G3728, G3729, G3730, G3733, G3795, G3797, G3802, G3804 |
| 2093 | G3733 | DNA | H. vulgare | Predicted polypeptide sequence is orthologous to G1274, G3722, G3723, G3724, G3731, G3732, G3803, G1275, G3719, G3720, G3721, G3725, G3726, G3727, G3728, G3729, G3730, G3795, G3797, G3802, G3804 |
| 2094 | G3733 | PRT | H. vulgare | Orthologous to G1274, G3722, G3723, G3724, G3731, G3732, G3803, G1275, G3719, G3720, G3721, G3725, G3726, G3727, G3728, G3729, G3730, G3795, G3797, G3802, G3804 |
| 2095 | G3735 | DNA | M. truncatula | Predicted polypeptide sequence is orthologous to G1791, G1792, G1795, G30, G3380, G3381, G3383, G3515, G3516, G3517, G3518, G3519, G3520, G3736, G3737, G3794, G3739, G3929, G4328, G4329, G4330 |
| 2096 | G3735 | PRT | M. truncatula | Orthologous to G1791, G1792, G1795, G30, G3380, G3381, G3383, G3515, G3516, G3517, G3518, G3519, G3520, G3736, G3737, G3794, G3739, G3929, G4328, G4329, G4330 |
| 2097 | G3736 | DNA | T. aestivum | Predicted polypeptide sequence is orthologous to G1791, G1792, G1795, G30, G3380, G3381, G3383, G3515, G3516, G3517, G3518, G3519, G3520, G3735, G3737, G3794, G3739, G3929, G4328, G4329, G4330 |
| 2098 | G3736 | PRT | T. aestivum | Orthologous to G1791, G1792, G1795, G30, G3380, G3381, G3383, G3515, G3516, G3517, G3518, G3519, G3520, G3735, G3737, G3794, G3739, G3929, G4328, G4329, G4330 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2099 | G3737 | DNA | *O. sativa* | Predicted polypeptide sequence is paralogous to G3380, G3381, G3383, G3515; orthologous to G1791, G1792, G1795, G30, G3516, G3517, G3518, G3519, G3520, G3735, G3736, G3794, G3739, G3929, G4328, G4329, G4330 |
| 2100 | G3737 | PRT | *O. sativa* | Paralogous to G3380, G3381, G3383, G3515; Orthologous to G1791, G1792, G1795, G30, G3516, G3517, G3518, G3519, G3520, G3735, G3736, G3794, G3739, G3929, G4328, G4329, G4330 |
| 2101 | G3739 | DNA | *Z. mays* | Predicted polypeptide sequence is paralogous to G3516, G3517, G3794, G3929; orthologous to G1791, G1792, G1795, G30, G3380, G3381, G3383, G3515, G3518, G3519, G3520, G3735, G3736, G3737, G4328, G4329, G4330 |
| 2102 | G3739 | PRT | *Z. mays* | Paralogous to G3516, G3517, G3794, G3929; Orthologous to G1791, G1792, G1795, G30, G3380, G3381, G3383, G3515, G3518, G3519, G3520, G3735, G3736, G3737, G4328, G4329, G4330 |
| 2103 | G3740 | DNA | *O. sativa* | Predicted polypeptide sequence is paralogous to G3741; orthologous to G3763, G3764, G2149, G2766, G3772 |
| 2104 | G3740 | PRT | *O. sativa* | Paralogous to G3741; Orthologous to G3763, G3764, G2149, G2766, G3772 |
| 2105 | G3741 | DNA | *O. sativa* | Predicted polypeptide sequence is paralogous to G3740; orthologous to G3763, G3764, G2149, G2766, G3772 |
| 2106 | G3741 | PRT | *O. sativa* | Paralogous to G3740; Orthologous to G3763, G3764, G2149, G2766, G3772 |
| 2107 | G3748 | DNA | *O. sativa* | Predicted polypeptide sequence is paralogous to G3749; orthologous to G589, G1061, G3774, G2791, G3760 |
| 2108 | G3748 | PRT | *O. sativa* | Paralogous to G3749; Orthologous to G589, G1061, G3774, G2791, G3760 |
| 2109 | G3749 | DNA | *O. sativa* | Predicted polypeptide sequence is paralogous to G3748; orthologous to G589, G1061, G3774, G2791, G3760 |
| 2110 | G3749 | PRT | *O. sativa* | Paralogous to G3748; Orthologous to G589, G1061, G3774, G2791, G3760 |
| 2111 | G3750 | DNA | *O. sativa* | Predicted polypeptide sequence is paralogous to G3752, G3751; orthologous to G3753, G793, G591, G4311, G4312, G4313 |
| 2112 | G3750 | PRT | *O. sativa* | Paralogous to G3752, G3751; Orthologous to G3753, G793, G591, G4311, G4312, G4313 |
| 2113 | G3751 | DNA | *O. sativa* | Predicted polypeptide sequence is paralogous to G3752, G3750; orthologous to G3753, G793, G591, G4311, G4312, G4313 |
| 2114 | G3751 | PRT | *O. sativa* | Paralogous to G3752, G3750; Orthologous to G3753, G793, G591, G4311, G4312, G4313 |
| 2115 | G3752 | DNA | *O. sativa* | Predicted polypeptide sequence is paralogous to G3751, G3750; orthologous to G3753, G793, G591, G4311, G4312, G4313 |
| 2116 | G3752 | PRT | *O. sativa* | Paralogous to G3751, G3750; Orthologous to G3753, G793, G591, G4311, G4312, G4313 |
| 2117 | G3753 | DNA | *Z. mays* | Predicted polypeptide sequence is paralogous to G4313; orthologous to G3752, G3751, G793, G591, G3750, G4311, G4312 |
| 2118 | G3753 | PRT | *Z. mays* | Paralogous to G4313; Orthologous to G3752, G3751, G793, G591, G3750, G4311, G4312 |
| 2119 | G3760 | DNA | *Z. mays* | Predicted polypeptide sequence is orthologous to G3748, G3749, G589, G1061, G3774, G2791 |
| 2120 | G3760 | PRT | *Z. mays* | Orthologous to G3748, G3749, G589, G1061, G3774, G2791 |
| 2121 | G3763 | DNA | *G. max* | Predicted polypeptide sequence is paralogous to G3764, G3772; orthologous to G2149, G2766, G3740, G3741 |
| 2122 | G3763 | PRT | *G. max* | Paralogous to G3764, G3772; Orthologous to G2149, G2766, G3740, G3741 |
| 2123 | G3764 | DNA | *G. max* | Predicted polypeptide sequence is paralogous to G3763, G3772; orthologous to G2149, G2766, G3740, G3741 |
| 2124 | G3764 | PRT | *G. max* | Paralogous to G3763, G3772; Orthologous to G2149, G2766, G3740, G3741 |
| 2125 | G3772 | DNA | *G. max* | Predicted polypeptide sequence is paralogous to G3763, G3764; orthologous to G2149, G2766, G3740, G3741 |
| 2126 | G3772 | PRT | *G. max* | Paralogous to G3763, G3764; Orthologous to G2149, G2766, G3740, G3741 |
| 2127 | G3774 | DNA | *G. max* | Predicted polypeptide sequence is orthologous to G3748, G3749, G589, G1061, G2791, G3760 |
| 2128 | G3774 | PRT | *G. max* | Orthologous to G3748, G3749, G589, G1061, G2791, G3760 |
| 2129 | G3794 | DNA | *Z. mays* | Predicted polypeptide sequence is paralogous to G3516, G3517, G3739, G3929; orthologous to G1791, G1792, G1795, G30, G3380, G3381, G3383, G3515, G3518, G3519, G3520, G3735, G3736, G3737, G4328, G4329, G4330 |
| 2130 | G3794 | PRT | *Z. mays* | Paralogous to G3516, G3517, G3739, G3929; Orthologous to G1791, G1792, G1795, G30, G3380, G3381, G3383, G3515, G3518, G3519, G3520, G3735, G3736, G3737, G4328, G4329, G4330 |
| 2131 | G3795 | DNA | *Capsicum annuum* | Predicted polypeptide sequence is orthologous to G1274, G3722, G3723, G3724, G3731, G3732, G3803, G1275, G3719, G3720, |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | G3721, G3725, G3726, G3727, G3728, G3729, G3730, G3733, G3797, G3802, G3804 |
| 2132 | G3795 | PRT | *Capsicum annuum* | Orthologous to G1274, G3722, G3723, G3724, G3731, G3732, G3803, G1275, G3719, G3720, G3721, G3725, G3726, G3727, G3728, G3729, G3730, G3733, G3797, G3802, G3804 |
| 2133 | G3797 | DNA | *Lactuca sativa* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3733, G3795, G3802, G3804 |
| 2134 | G3797 | PRT | *Lactuca sativa* | Orthologous to G1274, G3722, G3723, G3724, G3731, G3732, G3803, G1275, G3719, G3720, G3721, G3725, G3726, G3727, G3728, G3729, G3730, G3733, G3795, G3802, G3804 |
| 2135 | G38 | DNA | *A. thaliana* | Predicted polypeptide sequence is paralogous to G1141 |
| 2136 | G38 | PRT | *A. thaliana* | Paralogous to G1141 |
| 2137 | G3802 | DNA | *Sorghum bicolor* | Predicted polypeptide sequence is orthologous to G1274, G3722, G3723, G3724, G3731, G3732, G3803, G1275, G3719, G3720, G3721, G3725, G3726, G3727, G3728, G3729, G3730, G3733, G3795, G3797, G3804 |
| 2138 | G3802 | PRT | *Sorghum bicolor* | Orthologous to G1274, G3722, G3723, G3724, G3731, G3732, G3803, G1275, G3719, G3720, G3721, G3725, G3726, G3727, G3728, G3729, G3730, G3733, G3795, G3797, G3804 |
| 2139 | G3803 | DNA | *G. max* | Predicted polypeptide sequence is paralogous to G3723, G3724; orthologous to G1274, G3722, G3731, G3732, G1275, G3719, G3720, G3721, G3725, G3726, G3727, G3728, G3729, G3730, G3733, G3795, G3797, G3802, G3804 |
| 2140 | G3803 | PRT | *G. max* | Paralogous to G3723, G3724; Orthologous to G1274, G3722, G3731, G3732, G1275, G3719, G3720, G3721, G3725, G3726, G3727, G3728, G3729, G3730, G3733, G3795, G3797, G3802, G3804 |
| 2141 | G3804 | DNA | *Z. mays* | Predicted polypeptide sequence is paralogous to G3722, G3719, G3720, G3727, G3728; orthologous to G1274, G3723, G3724, G3731, G3732, G3803, G1275, G3721, G3725, G3726, G3729, G3730, G3733, G3795, G3797, G3802 |
| 2142 | G3804 | PRT | *Z. mays* | Paralogous to G3722, G3719, G3720, G3727, G3728; Orthologous to G1274, G3723, G3724, G3731, G3732, G3803, G1275, G3721, G3725, G3726, G3729, G3730, G3733, G3795, G3797, G3802 |
| 2143 | G3815 | DNA | *O. sativa* | Predicted polypeptide sequence is orthologous to G1768, G2633, G2697, G313, G852, G3825 |
| 2144 | G3815 | PRT | *O. sativa* | Orthologous to G1768, G2633, G2697, G313, G852, G3825 |
| 2145 | G3816 | DNA | *T. aestivum* | Predicted polypeptide sequence is orthologous to G2738, G3009, G307, G308, G309, G3817, G3818, G3819 |
| 2146 | G3816 | PRT | *T. aestivum* | Orthologous to G2738, G3009, G307, G308, G309, G3817, G3818, G3819 |
| 2147 | G3817 | DNA | *O. sativa* | Predicted polypeptide sequence is paralogous to G3819; orthologous to G2738, G3009, G307, G308, G309, G3816, G3818 |
| 2148 | G3817 | PRT | *O. sativa* | Paralogous to G3819; Orthologous to G2738, G3009, G307, G308, G309, G3816, G3818 |
| 2149 | G3818 | DNA | *G. max* | Predicted polypeptide sequence is orthologous to G2738, G3009, G307, G308, G309, G3816, G3817, G3819 |
| 2150 | G3818 | PRT | *G. max* | Orthologous to G2738, G3009, G307, G308, G309, G3816, G3817, G3819 |
| 2151 | G3819 | DNA | *O. sativa* | Predicted polypeptide sequence is paralogous to G3817; orthologous to G2738, G3009, G307, G308, G309, G3816, G3818 |
| 2152 | G3819 | PRT | *O. sativa* | Paralogous to G3817; Orthologous to G2738, G3009, G307, G308, G309, G3816, G3818 |
| 2153 | G3821 | DNA | *Pisum sativum* | Predicted polypeptide sequence is orthologous to G306, G3822 |
| 2154 | G3821 | PRT | *Pisum sativum* | Orthologous to G306, G3822 |
| 2155 | G3822 | DNA | *Z. mays* | Predicted polypeptide sequence is orthologous to G306, G3821 |
| 2156 | G3822 | PRT | *Z. mays* | Orthologous to G306, G3821 |
| 2157 | G3825 | DNA | *S. lycopersicum* | Predicted polypeptide sequence is orthologous to G1768, G2633, G2697, G313, G852, G3815 |
| 2158 | G3825 | PRT | *S. lycopersicum* | Orthologous to G1768, G2633, G2697, G313, G852, G3815 |
| 2159 | G3839 | DNA | *Z. mays* | Predicted polypeptide sequence is paralogous to G3937; orthologous to G620, G1821, G3939 |
| 2160 | G3839 | PRT | *Z. mays* | Paralogous to G3937; Orthologous to G620, G1821, G3939 |
| 2161 | G384 | DNA | *A. thaliana* | Predicted polypeptide sequence is paralogous to G1588, G385 |
| 2162 | G384 | PRT | *A. thaliana* | Paralogous to G1588, G385 |
| 2163 | G3841 | DNA | *S. lycopersicum* | Predicted polypeptide sequence is paralogous to G3843, G3852, G4626; orthologous to G22, G1006, G28, G3430, G3659, G3660, G3661, G3717, G3718, G3844, G3845, G3846, G3848, G3856, G3857, G3858, G3864, G3865, G5171 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2164 | G3841 | PRT | S. lycopersicum | Paralogous to G3843, G3852, G4626; Orthologous to G22, G1006, G28, G3430, G3659, G3660, G3661, G3717, G3718, G3844, G3845, G3846, G3848, G3856, G3857, G3858, G3864, G3865, G5171 |
| 2165 | G3843 | DNA | S. lycopersicum | Predicted polypeptide sequence is paralogous to G3841, G3852, G4626; orthologous to G22, G1006, G28, G3430, G3659, G3660, G3661, G3717, G3718, G3844, G3845, G3846, G3848, G3856, G3857, G3858, G3864, G3865, G5171 |
| 2166 | G3843 | PRT | S. lycopersicum | Paralogous to G3841, G3852, G4626; Orthologous to G22, G1006, G28, G3430, G3659, G3660, G3661, G3717, G3718, G3844, G3845, G3846, G3848, G3856, G3857, G3858, G3864, G3865, G5171 |
| 2167 | G3844 | DNA | M. truncatula | Predicted polypeptide sequence is orthologous to G22, G1006, G28, G3430, G3659, G3660, G3661, G3717, G3718, G3841, G3843, G3845, G3846, G3848, G3852, G3856, G3857, G3858, G3864, G3865, G4626, G5171 |
| 2168 | G3844 | PRT | M. truncatula | Orthologous to G22, G1006, G28, G3430, G3659, G3660, G3661, G3717, G3718, G3841, G3843, G3845, G3846, G3848, G3852, G3856, G3857, G3858, G3864, G3865, G4626, G5171 |
| 2169 | G3845 | DNA | N. tabacum | Predicted polypeptide sequence is paralogous to G3846; orthologous to G22, G1006, G28, G3430, G3659, G3660, G3661, G3717, G3718, G3841, G3843, G3844, G3848, G3852, G3856, G3857, G3858, G3864, G3865, G4626, G5171 |
| 2170 | G3845 | PRT | N. tabacum | Paralogous to G3846; Orthologous to G22, G1006, G28, G3430, G3659, G3660, G3661, G3717, G3718, G3841, G3843, G3844, G3848, G3852, G3856, G3857, G3858, G3864, G3865, G4626, G5171 |
| 2171 | G3846 | DNA | N. tabacum | Predicted polypeptide sequence is paralogous to G3845; orthologous to G22, G1006, G28, G3430, G3659, G3660, G3661, G3717, G3718, G3841, G3843, G3844, G3848, G3852, G3856, G3857, G3858, G3864, G3865, G4626, G5171 |
| 2172 | G3846 | PRT | N. tabacum | Paralogous to G3845; Orthologous to G22, G1006, G28, G3430, G3659, G3660, G3661, G3717, G3718, G3841, G3843, G3844, G3848, G3852, G3856, G3857, G3858, G3864, G3865, G4626, G5171 |
| 2173 | G3848 | DNA | O. sativa | Predicted polypeptide sequence is paralogous to G3430, G5171; orthologous to G22, G1006, G28, G3659, G3660, G3661, G3717, G3718, G3841, G3843, G3844, G3845, G3846, G3852, G3856, G3857, G3858, G3864, G3865, G4626 |
| 2174 | G3848 | PRT | O. sativa | Paralogous to G3430, G5171; Orthologous to G22, G1006, G28, G3659, G3660, G3661, G3717, G3718, G3841, G3843, G3844, G3845, G3846, G3852, G3856, G3857, G3858, G3864, G3865, G4626 |
| 2175 | G3849 | DNA | S. lycopersicum | Predicted polypeptide sequence is orthologous to G1419, G43, G46, G1004, G29 |
| 2176 | G3849 | PRT | S. lycopersicum | Orthologous to G1419, G43, G46, G1004, G29 |
| 2177 | G3851 | DNA | S. lycopersicum | Predicted polypeptide sequence is orthologous to G19 |
| 2178 | G3851 | PRT | S. lycopersicum | Orthologous to G19 |
| 2179 | G3852 | DNA | S. lycopersicum | Predicted polypeptide sequence is paralogous to G3841, G3843, G4626; orthologous to G22, G1006, G28, G3430, G3659, G3660, G3661, G3717, G3718, G3844, G3845, G3846, G3848, G3856, G3857, G3858, G3864, G3865, G5171 |
| 2180 | G3852 | PRT | S. lycopersicum | Paralogous to G3841, G3843, G4626; Orthologous to G22, G1006, G28, G3430, G3659, G3660, G3661, G3717, G3718, G3844, G3845, G3846, G3848, G3856, G3857, G3858, G3864, G3865, G5171 |
| 2181 | G3856 | DNA | Z. mays | Predicted polypeptide sequence is paralogous to G3661; orthologous to G22, G1006, G28, G3430, G3659, G3660, G3717, G3718, G3841, G3843, G3844, G3845, G3846, G3848, G3852, G3857, G3858, G3864, G3865, G4626, G5171 |
| 2182 | G3856 | PRT | Z. mays | Paralogous to G3661; Orthologous to G22, G1006, G28, G3430, G3659, G3660, G3717, G3718, G3841, G3843, G3844, G3845, G3846, G3848, G3852, G3857, G3858, G3864, G3865, G4626, G5171 |
| 2183 | G3857 | DNA | S. tuberosum | Predicted polypeptide sequence is paralogous to G3858; orthologous to G22, G1006, G28, G3430, G3659, G3660, G3661, G3717, G3718, G3841, G3843, G3844, G3845, G3846, G3848, G3852, G3856, G3864, G3865, G4626, G5171 |
| 2184 | G3857 | PRT | S. tuberosum | Paralogous to G3858; Orthologous to G22, G1006, G28, G3430, G3659, G3660, G3661, G3717, G3718, G3841, G3843, G3844, G3845, G3846, G3848, G3852, G3856, G3864, G3865, G4626, G5171 |
| 2185 | G3858 | DNA | S. tuberosum | Predicted polypeptide sequence is paralogous to G3857; orthologous to G22, G1006, G28, G3430, G3659, G3660, G3661, G3717, G3718, G3841, G3843, G3844, G3845, G3846, G3848, G3852, G3856, G3864, G3865, G4626, G5171 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2186 | G3858 | PRT | *S. tuberosum* | Paralogous to G3857; Orthologous to G22, G1006, G28, G3430, G3659, G3660, G3661, G3717, G3718, G3841, G3843, G3844, G3845, G3846, G3848, G3852, G3856, G3864, G3865, G4626, G5171 |
| 2187 | G3859 | DNA | *Flaveria trinervia* | Predicted polypeptide sequence is orthologous to G2989, G2990, G3680, G3681, G3691, G3860, G3861, G3934 |
| 2188 | G3859 | PRT | *Flaveria trinervia* | Orthologous to G2989, G2990, G3680, G3681, G3691, G3860, G3861, G3934 |
| 2189 | G386 | DNA | *A. thaliana* | Predicted polypeptide sequence is paralogous to G707 |
| 2190 | G386 | PRT | *A. thaliana* | Paralogous to G707 |
| 2191 | G3860 | DNA | *Flaveria bidentis* | Predicted polypeptide sequence is paralogous to G3861; orthologous to G2989, G2990, G3680, G3681, G3691, G3859, G3934 |
| 2192 | G3860 | PRT | *Flaveria bidentis* | Paralogous to G3861; Orthologous to G2989, G2990, G3680, G3681, G3691, G3859, G3934 |
| 2193 | G3861 | DNA | *Flaveria bidentis* | Predicted polypeptide sequence is paralogous to G3860; orthologous to G2989, G2990, G3680, G3681, G3691, G3859, G3934 |
| 2194 | G3861 | PRT | *Flaveria bidentis* | Paralogous to G3860; Orthologous to G2989, G2990, G3680, G3681, G3691, G3859, G3934 |
| 2195 | G3864 | DNA | *T. aestivum* | Predicted polypeptide sequence is paralogous to G3865; orthologous to G22, G1006, G28, G3430, G3659, G3660, G3661, G3717, G3718, G3841, G3843, G3844, G3845, G3846, G3848, G3852, G3856, G3857, G3858, G4626, G5171 |
| 2196 | G3864 | PRT | *T. aestivum* | Paralogous to G3865; Orthologous to G22, G1006, G28, G3430, G3659, G3660, G3661, G3717, G3718, G3841, G3843, G3844, G3845, G3846, G3848, G3852, G3856, G3857, G3858, G4626, G5171 |
| 2197 | G3865 | DNA | *T. aestivum* | Predicted polypeptide sequence is paralogous to G3864; orthologous to G22, G1006, G28, G3430, G3659, G3660, G3661, G3717, G3718, G3841, G3843, G3844, G3845, G3846, G3848, G3852, G3856, G3857, G3858, G4626, G5171 |
| 2198 | G3865 | PRT | *T. aestivum* | Paralogous to G3864; Orthologous to G22, G1006, G28, G3430, G3659, G3660, G3661, G3717, G3718, G3841, G3843, G3844, G3845, G3846, G3848, G3852, G3856, G3857, G3858, G4626, G5171 |
| 2199 | G3866 | DNA | *Z. mays* | Predicted polypeptide sequence is paralogous to G3434, G3435, G3436, G3437, G3876, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2200 | G3866 | PRT | *Z. mays* | Paralogous to G3434, G3435, G3436, G3437, G3876, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2201 | G3867 | DNA | *P. patens* | Predicted polypeptide sequence is orthologous to G489, G714, G3542, G3544, G3545, G3547, G3549, G3550, G3551, G3552, G3553, G3554, G3555, G3892, G3893, G3894, G3896, G4257, G4256 |
| 2202 | G3867 | PRT | *P. patens* | Orthologous to G489, G714, G3542, G3544, G3545, G3547, G3549, G3550, G3551, G3552, G3553, G3554, G3555, G3892, G3893, G3894, G3896, G4257, G4256 |
| 2203 | G3868 | DNA | *P. patens* | Predicted polypeptide sequence is paralogous to G3870; orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 2204 | G3868 | PRT | *P. patens* | Paralogous to G3870; Orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 2205 | G3870 | DNA | *P. patens* | Predicted polypeptide sequence is paralogous to G3868; orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 2206 | G3870 | PRT | *P. patens* | Paralogous to G3868; Orthologous to G1364, G2345, G481, G482, G485, G3394, G3395, G3396, G3397, G3398, G3429, G3434, G3435, G3436, G3437, G3470, G3471, G3472, G3473, G3474, G3475, G3476, G3478, G3866, G3873, G3874, G3875, G3876, G3938, G4272, G4276 |
| 2207 | G3873 | DNA | *G. max* | Predicted polypeptide sequence is paralogous to G3470, G3471, G3472, G3473, G3474, G3475, G3476, G3478, G3874, G3875; |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| | | | | orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2208 | G3873 | PRT | *G. max* | Paralogous to G3470, G3471, G3472, G3473, G3474, G3475, G3476, G3478, G3874, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2209 | G3874 | DNA | *G. max* | Predicted polypeptide sequence is paralogous to G3470, G3471, G3472, G3473, G3474, G3475, G3476, G3478, G3873, G3875; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2210 | G3874 | PRT | *G. max* | Paralogous to G3470, G3471, G3472, G3473, G3474, G3475, G3476, G3478, G3873, G3875; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2211 | G3875 | DNA | *G. max* | Predicted polypeptide sequence is paralogous to G3470, G3471, G3472, G3473, G3474, G3475, G3476, G3478, G3873, G3874; orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2212 | G3875 | PRT | *G. max* | Paralogous to G3470, G3471, G3472, G3473, G3474, G3475, G3476, G3478, G3873, G3874; Orthologous to G1364, G2345, G481, G482, G485, G3394, G3395, G3396, G3397, G3398, G3429, G3434, G3435, G3436, G3437, G3866, G3868, G3870, G3876, G3938, G4272, G4276 |
| 2213 | G3876 | DNA | *Z. mays* | Predicted polypeptide sequence is paralogous to G3434, G3435, G3436, G3437, G3866, G4272, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2214 | G3876 | PRT | *Z. mays* | Paralogous to G3434, G3435, G3436, G3437, G3866, G4272, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2215 | G3883 | DNA | *G. raimondii* | Predicted polypeptide sequence is orthologous to G1646, G715, G3884, G3885, G3886, G3889, G3543, G4259 |
| 2216 | G3883 | PRT | *G. raimondii* | Orthologous to G1646, G715, G3884, G3885, G3886, G3889, G3543, G4259 |
| 2217 | G3884 | DNA | *N. benthamiana* | Predicted polypeptide sequence is orthologous to G1646, G715, G3883, G3885, G3886, G3889, G3543, G4259 |
| 2218 | G3884 | PRT | *N. benthamiana* | Orthologous to G1646, G715, G3883, G3885, G3886, G3889, G3543, G4259 |
| 2219 | G3885 | DNA | *S. tuberosum* | Predicted polypeptide sequence is orthologous to G1646, G715, G3883, G3884, G3886, G3889, G3543, G4259 |
| 2220 | G3885 | PRT | *S. tuberosum* | Orthologous to G1646, G715, G3883, G3884, G3886, G3889, G3543, G4259 |
| 2221 | G3886 | DNA | *G. max* | Predicted polypeptide sequence is orthologous to G1646, G715, G3883, G3884, G3885, G3889, G3543, G4259 |
| 2222 | G3886 | PRT | *G. max* | Orthologous to G1646, G715, G3883, G3884, G3885, G3889, G3543, G4259 |
| 2223 | G3889 | DNA | *Z. mays* | Predicted polypeptide sequence is paralogous to G4259; orthologous to G1646, G715, G3883, G3884, G3885, G3886, G3543 |
| 2224 | G3889 | PRT | *Z. mays* | Paralogous to G4259; Orthologous to G1646, G715, G3883, G3884, G3885, G3886, G3543 |
| 2225 | G389 | DNA | *A. thaliana* | Predicted polypeptide sequence is paralogous to G1535 |
| 2226 | G389 | PRT | *A. thaliana* | Paralogous to G1535 |
| 2227 | G3892 | DNA | *S. tuberosum* | Predicted polypeptide sequence is paralogous to G3893; orthologous to G489, G714, G3542, G3544, G3545, G3547, G3549, G3550, G3551, G3552, G3553, G3554, G3555, G3867, G3894, G3896, G4257, G4256 |
| 2228 | G3892 | PRT | *S. tuberosum* | Paralogous to G3893; Orthologous to G489, G714, G3542, G3544, G3545, G3547, G3549, G3550, G3551, G3552, G3553, G3554, G3555, G3867, G3894, G3896, G4257, G4256 |
| 2229 | G3893 | DNA | *S. tuberosum* | Predicted polypeptide sequence is paralogous to G3892; orthologous to G489, G714, G3542, G3544, G3545, G3547, G3549, G3550, G3551, G3552, G3553, G3554, G3555, G3867, G3894, G3896, G4257, G4256 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2230 | G3893 | PRT | S. tuberosum | Paralogous to G3892; Orthologous to G489, G714, G3542, G3544, G3545, G3547, G3549, G3550, G3551, G3552, G3553, G3554, G3555, G3867, G3894, G3896, G4257, G4256 |
| 2231 | G3894 | DNA | S. lycopersicum | Predicted polypeptide sequence is paralogous to G3553, G3554, G3555; orthologous to G489, G714, G3542, G3544, G3545, G3547, G3549, G3550, G3551, G3552, G3867, G3892, G3893, G3896, G4257, G4256 |
| 2232 | G3894 | PRT | S. lycopersicum | Paralogous to G3553, G3554, G3555; Orthologous to G489, G714, G3542, G3544, G3545, G3547, G3549, G3550, G3551, G3552, G3867, G3892, G3893, G3896, G4257, G4256 |
| 2233 | G3896 | DNA | M. truncatula | Predicted polypeptide sequence is orthologous to G489, G714, G3542, G3544, G3545, G3547, G3549, G3550, G3551, G3552, G3553, G3554, G3555, G3867, G3892, G3893, G3894, G4257, G4256 |
| 2234 | G3896 | PRT | M. truncatula | Orthologous to G489, G714, G3542, G3544, G3545, G3547, G3549, G3550, G3551, G3552, G3553, G3554, G3555, G3867, G3892, G3893, G3894, G4257, G4256 |
| 2235 | G390 | DNA | A. thaliana | Predicted polypeptide sequence is paralogous to G1548, G391, G392, G438 |
| 2236 | G390 | PRT | A. thaliana | Paralogous to G1548, G391, G392, G438 |
| 2237 | G391 | DNA | A. thaliana | Predicted polypeptide sequence is paralogous to G1548, G390, G392, G438 |
| 2238 | G391 | PRT | A. thaliana | Paralogous to G1548, G390, G392, G438 |
| 2239 | G3924 | DNA | O. sativa | Predicted polypeptide sequence is orthologous to G926, G2632, G4261 |
| 2240 | G3924 | PRT | O. sativa | Orthologous to G926, G2632, G4261 |
| 2241 | G3929 | DNA | Z. mays | Predicted polypeptide sequence is paralogous to G3516, G3517, G3794, G3739; orthologous to G1791, G1792, G1795, G30, G3380, G3381, G3383, G3515, G3518, G3519, G3520, G3735, G3736, G3737, G4328, G4329, G4330 |
| 2242 | G3929 | PRT | Z. mays | Paralogous to G3516, G3517, G3794, G3739; Orthologous to G1791, G1792, G1795, G30, G3380, G3381, G3383, G3515, G3518, G3519, G3520, G3735, G3736, G3737, G4328, G4329, G4330 |
| 2243 | G3930 | DNA | A. thaliana | Predicted polypeptide sequence is paralogous to G1816, G225, G226, G2718, G682; orthologous to G3392, G3393, G3431, G3444, G3445, G3446, G3447, G3448, G3449, G3450 |
| 2244 | G3930 | PRT | A. thaliana | Paralogous to G1816, G225, G226, G2718, G682; Orthologous to G3392, G3393, G3431, G3444, G3445, G3446, G3447, G3448, G3449, G3450 |
| 2245 | G3934 | DNA | G. max | Predicted polypeptide sequence is orthologous to G2989, G2990, G3680, G3681, G3691, G3859, G3860, G3861 |
| 2246 | G3934 | PRT | G. max | Orthologous to G2989, G2990, G3680, G3681, G3691, G3859, G3860, G3861 |
| 2247 | G3937 | DNA | Z. mays | Predicted polypeptide sequence is paralogous to G3839; orthologous to G620, G1821, G3939 |
| 2248 | G3937 | PRT | Z. mays | Paralogous to G3839; Orthologous to G620, G1821, G3939 |
| 2249 | G3938 | DNA | O. sativa | Predicted polypeptide sequence is paralogous to G3395, G3396, G3397, G3398, G3429; orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 2250 | G3938 | PRT | O. sativa | Paralogous to G3395, G3396, G3397, G3398, G3429; Orthologous to G1364, G2345, G481, G482, G485, G3394, G3434, G3435, G3436, G3437, G3470, G3471, G3472, G3473, G3474, G3475, G3476, G3478, G3866, G3868, G3870, G3873, G3874, G3875, G3876, G4272, G4276 |
| 2251 | G3939 | DNA | O. sativa | Predicted polypeptide sequence is orthologous to G620, G1821, G3839, G3937 |
| 2252 | G3939 | PRT | O. sativa | Orthologous to G620, G1821, G3839, G3937 |
| 2253 | G3957 | DNA | Capsicum annuum | Predicted polypeptide sequence is orthologous to G14, G4, G3974 |
| 2254 | G3957 | PRT | Capsicum annuum | Orthologous to G14, G4, G3974 |
| 2255 | G3974 | DNA | S. lycopersicum | Predicted polypeptide sequence is orthologous to G14, G4, G3957 |
| 2256 | G3974 | PRT | S. lycopersicum | Orthologous to G14, G4, G3957 |
| 2257 | G398 | DNA | A. thaliana | Predicted polypeptide sequence is paralogous to G399, G964 |
| 2258 | G398 | PRT | A. thaliana | Paralogous to G399, G964 |
| 2259 | G3980 | DNA | G. max | Predicted polypeptide sequence is paralogous to G3484, G3485, G3981; orthologous to G152, G153, G1760, G860, G3479, G3480, G3481, G3482, G3483, G3487, G3488, G3489, G3982 |
| 2260 | G3980 | PRT | G. max | Paralogous to G3484, G3485, G3981; Orthologous to G152, G153, G1760, G860, G3479, G3480, G3481, G3482, G3483, G3487, G3488, G3489, G3982 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2261 | G3981 | DNA | *G. max* | Predicted polypeptide sequence is paralogous to G3484, G3485, G3980; orthologous to G152, G153, G1760, G860, G3479, G3480, G3481, G3482, G3483, G3487, G3488, G3489, G3982 |
| 2262 | G3981 | PRT | *G. max* | Paralogous to G3484, G3485, G3980; Orthologous to G152, G153, G1760, G860, G3479, G3480, G3481, G3482, G3483, G3487, G3488, G3489, G3982 |
| 2263 | G3982 | DNA | *A. majus* | Predicted polypeptide sequence is orthologous to G152, G153, G1760, G860, G3479, G3480, G3481, G3482, G3483, G3484, G3485, G3487, G3488, G3489, G3980, G3981 |
| 2264 | G3982 | PRT | *A. majus* | Orthologous to G152, G153, G1760, G860, G3479, G3480, G3481, G3482, G3483, G3487, G3488, G3489, G3980, G3981 |
| 2265 | G3984 | DNA | *S. lycopersicum* | Predicted polypeptide sequence is orthologous to G1140, G861, G3985, G3986, G3987, G3988, G3989, G3990, G3991, G3992, G3998, G3999, G4060 |
| 2266 | G3984 | PRT | *S. lycopersicum* | Orthologous to G1140, G861, G3985, G3986, G3987, G3988, G3989, G3990, G3991, G3992, G3998, G3999, G4060 |
| 2267 | G3985 | DNA | *Z. mays* | Predicted polypeptide sequence is paralogous to G3986, G3987, G3990; orthologous to G1140, G861, G3984, G3988, G3989, G3991, G3992, G3998, G3999, G4060 |
| 2268 | G3985 | PRT | *Z. mays* | Paralogous to G3986, G3987, G3990; Orthologous to G1140, G861, G3984, G3988, G3989, G3991, G3992, G3998, G3999, G4060 |
| 2269 | G3986 | DNA | *Z. mays* | Predicted polypeptide sequence is paralogous to G3985, G3987, G3990; orthologous to G1140, G861, G3984, G3988, G3989, G3991, G3992, G3998, G3999, G4060 |
| 2270 | G3986 | PRT | *Z. mays* | Paralogous to G3985, G3987, G3990; Orthologous to G1140, G861, G3984, G3988, G3989, G3991, G3992, G3998, G3999, G4060 |
| 2271 | G3987 | DNA | *Z. mays* | Predicted polypeptide sequence is paralogous to G3985, G3986, G3990; orthologous to G1140, G861, G3984, G3988, G3989, G3991, G3992, G3998, G3999, G4060 |
| 2272 | G3987 | PRT | *Z. mays* | Paralogous to G3985, G3986, G3990; Orthologous to G1140, G861, G3984, G3988, G3989, G3991, G3992, G3998, G3999, G4060 |
| 2273 | G3988 | DNA | *O. sativa* | Predicted polypeptide sequence is paralogous to G4060; orthologous to G1140, G861, G3984, G3985, G3986, G3987, G3989, G3990, G3991, G3992, G3998, G3999 |
| 2274 | G3988 | PRT | *O. sativa* | Paralogous to G4060; Orthologous to G1140, G861, G3984, G3985, G3986, G3987, G3989, G3990, G3991, G3992, G3998, G3999 |
| 2275 | G3989 | DNA | *G. max* | Predicted polypeptide sequence is paralogous to G3991, G3992; orthologous to G1140, G861, G3984, G3985, G3986, G3987, G3988, G3990, G3998, G3999, G4060 |
| 2276 | G3989 | PRT | *G. max* | Paralogous to G3991, G3992; Orthologous to G1140, G861, G3984, G3985, G3986, G3987, G3988, G3990, G3998, G3999, G4060 |
| 2277 | G3990 | DNA | *Z. mays* | Predicted polypeptide sequence is paralogous to G3985, G3986, G3987; orthologous to G1140, G861, G3984, G3988, G3989, G3991, G3992, G3998, G3999, G4060 |
| 2278 | G3990 | PRT | *Z. mays* | Paralogous to G3985, G3986, G3987; Orthologous to G1140, G861, G3984, G3988, G3989, G3991, G3992, G3998, G3999, G4060 |
| 2279 | G3991 | DNA | *G. max* | Predicted polypeptide sequence is paralogous to G3989, G3992; orthologous to G1140, G861, G3984, G3985, G3986, G3987, G3988, G3990, G3998, G3999, G4060 |
| 2280 | G3991 | PRT | *G. max* | Paralogous to G3989, G3992; Orthologous to G1140, G861, G3984, G3985, G3986, G3987, G3988, G3990, G3998, G3999, G4060 |
| 2281 | G3992 | DNA | *G. max* | Predicted polypeptide sequence is paralogous to G3989, G3991; orthologous to G1140, G861, G3984, G3985, G3986, G3987, G3988, G3990, G3998, G3999, G4060 |
| 2282 | G3992 | PRT | *G. max* | Paralogous to G3989, G3991; Orthologous to G1140, G861, G3984, G3985, G3986, G3987, G3988, G3990, G3998, G3999, G4060 |
| 2283 | G3998 | DNA | *B. rapa* | Predicted polypeptide sequence is orthologous to G1140, G861, G3984, G3985, G3986, G3987, G3988, G3989, G3990, G3991, G3992, G3999, G4060 |
| 2284 | G3998 | PRT | *B. rapa* | Orthologous to G1140, G861, G3984, G3985, G3986, G3987, G3988, G3989, G3990, G3991, G3992, G3999, G4060 |
| 2285 | G3999 | DNA | *E. occidentalis* | Predicted polypeptide sequence is orthologous to G1140, G861, G3984, G3985, G3986, G3987, G3988, G3989, G3990, G3991, G3992, G3998, G4060 |
| 2286 | G3999 | PRT | *E. occidentalis* | Orthologous to G1140, G861, G3984, G3985, G3986, G3987, G3988, G3989, G3990, G3991, G3992, G3998, G4060 |
| 2287 | G40 | DNA | *A. thaliana* | Predicted polypeptide sequence is paralogous to G2107, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2288 | G40 | PRT | *A. thaliana* | Paralogous to G2107, G2513, G41, G42, G912; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2289 | G4019 | DNA | *G. max* | Predicted polypeptide sequence is orthologous to G1478, G1929 |
| 2290 | G4019 | PRT | *G. max* | Orthologous to G1478, G1929 |
| 2291 | G4060 | DNA | *O. sativa* | Predicted polypeptide sequence is paralogous to G3988; orthologous to G1140, G861, G3984, G3985, G3986, G3987, G3989, G3990, G3991, G3992, G3998, G3999 |
| 2292 | G4060 | PRT | *O. sativa* | Paralogous to G3988; Orthologous to G1140, G861, G3984, G3985, G3986, G3987, G3989, G3990, G3991, G3992, G3998, G3999 |
| 2293 | G4061 | DNA | *S. lycopersicum* | Predicted polypeptide sequence is orthologous to G149, G627, G1011, G154, G1797, G1798, G4062, G4063, G4064, G4065, G4066, G4067 |
| 2294 | G4061 | PRT | *S. lycopersicum* | Orthologous to G149, G627, G1011, G154, G1797, G1798, G4062, G4063, G4064, G4065, G4066, G4067 |
| 2295 | G4062 | DNA | *B. rapa* | Predicted polypeptide sequence is orthologous to G149, G627, G1011, G154, G1797, G1798, G4061, G4063, G4064, G4065, G4066, G4067 |
| 2296 | G4062 | PRT | *B. rapa* | Orthologous to G149, G627, G1011, G154, G1797, G1798, G4061, G4063, G4064, G4065, G4066, G4067 |
| 2297 | G4063 | DNA | *G. max* | Predicted polypeptide sequence is paralogous to G4064; orthologous to G149, G627, G1011, G154, G1797, G1798, G4061, G4062, G4065, G4066, G4067 |
| 2298 | G4063 | PRT | *G. max* | Paralogous to G4064; Orthologous to G149, G627, G1011, G154, G1797, G1798, G4061, G4062, G4065, G4066, G4067 |
| 2299 | G4064 | DNA | *G. max* | Predicted polypeptide sequence is paralogous to G4063; orthologous to G149, G627, G1011, G154, G1797, G1798, G4061, G4062, G4065, G4066, G4067 |
| 2300 | G4064 | PRT | *G. max* | Paralogous to G4063; Orthologous to G149, G627, G1011, G154, G1797, G1798, G4061, G4062, G4065, G4066, G4067 |
| 2301 | G4065 | DNA | *Z. mays* | Predicted polypeptide sequence is orthologous to G149, G627, G1011, G154, G1797, G1798, G4061, G4062, G4063, G4064, G4066, G4067 |
| 2302 | G4065 | PRT | *Z. mays* | Orthologous to G149, G627, G1011, G154, G1797, G1798, G4061, G4062, G4063, G4064, G4066, G4067 |
| 2303 | G4066 | DNA | *O. sativa* | Predicted polypeptide sequence is paralogous to G4067; orthologous to G149, G627, G1011, G154, G1797, G1798, G4061, G4062, G4063, G4064, G4065 |
| 2304 | G4066 | PRT | *O. sativa* | Paralogous to G4067; Orthologous to G149, G627, G1011, G154, G1797, G1798, G4061, G4062, G4063, G4064, G4065 |
| 2305 | G4067 | DNA | *O. sativa* | Predicted polypeptide sequence is paralogous to G4066; orthologous to G149, G627, G1011, G154, G1797, G1798, G4061, G4062, G4063, G4064, G4065 |
| 2306 | G4067 | PRT | *O. sativa* | Paralogous to G4066; Orthologous to G149, G627, G1011, G154, G1797, G1798, G4061, G4062, G4063, G4064, G4065 |
| 2307 | G4079 | DNA | *S. lycopersicum* | Predicted polypeptide sequence is orthologous to G1750, G1421, G4080, G440, G864, G4283, G4284, G4285, G4286, G4287, G4288, G4289, G4290, G4291, G4292, G4293 |
| 2308 | G4079 | PRT | *S. lycopersicum* | Orthologous to G1750, G1421, G4080, G440, G864, G4283, G4284, G4285, G4286, G4287, G4288, G4289, G4290, G4291, G4292, G4293 |
| 2309 | G4080 | DNA | *N. tabacum* | Predicted polypeptide sequence is orthologous to G1750, G1421, G4079, G440, G864, G4283, G4284, G4285, G4286, G4287, G4288, G4289, G4290, G4291, G4292, G4293 |
| 2310 | G4080 | PRT | *N. tabacum* | Orthologous to G1750, G1421, G4079, G440, G864, G4283, G4284, G4285, G4286, G4287, G4288, G4289, G4290, G4291, G4292, G4293 |
| 2311 | G41 | DNA | *A. thaliana* | Predicted polypeptide sequence is paralogous to G40, G2107, G2513, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2312 | G41 | PRT | *A. thaliana* | Paralogous to G40, G2107, G2513, G42, G912; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2313 | G412 | DNA | *A. thaliana* | Predicted polypeptide sequence is paralogous to G1538, G1545 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2314 | G412 | PRT | *A. thaliana* | Paralogous to G1538, G1545 |
| 2315 | G42 | DNA | *A. thaliana* | Predicted polypeptide sequence is paralogous to G40, G2107, G2513, G41, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2316 | G42 | PRT | *A. thaliana* | Paralogous to G40, G2107, G2513, G41, G912; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2317 | G4218 | DNA | *G. max* | Predicted polypeptide sequence is paralogous to G4219, G4220, G4221, G4222, G4223, G4224, G4225; orthologous to G207, G227, G230, G242, G4226, G4227, G4228, G4229, G4230, G4231, G4232, G4234, G4235, G4236, G4237, G4238 |
| 2318 | G4218 | PRT | *G. max* | Paralogous to G4219, G4220, G4221, G4222, G4223, G4224, G4225; Orthologous to G207, G227, G230, G242, G4226, G4227, G4228, G4229, G4230, G4231, G4232, G4234, G4235, G4236, G4237, G4238 |
| 2319 | G4219 | DNA | *G. max* | Predicted polypeptide sequence is paralogous to G4218, G4220, G4221, G4222, G4223, G4224, G4225; orthologous to G207, G227, G230, G242, G4226, G4227, G4228, G4229, G4230, G4231, G4232, G4234, G4235, G4236, G4237, G4238 |
| 2320 | G4219 | PRT | *G. max* | Paralogous to G4218, G4220, G4221, G4222, G4223, G4224, G4225; Orthologous to G207, G227, G230, G242, G4226, G4227, G4228, G4229, G4230, G4231, G4232, G4234, G4235, G4236, G4237, G4238 |
| 2321 | G4220 | DNA | *G. max* | Predicted polypeptide sequence is paralogous to G4218, G4219, G4221, G4222, G4223, G4224, G4225; orthologous to G207, G227, G230, G242, G4226, G4227, G4228, G4229, G4230, G4231, G4232, G4234, G4235, G4236, G4237, G4238 |
| 2322 | G4220 | PRT | *G. max* | Paralogous to G4218, G4219, G4221, G4222, G4223, G4224, G4225; Orthologous to G207, G227, G230, G242, G4226, G4227, G4228, G4229, G4230, G4231, G4232, G4234, G4235, G4236, G4237, G4238 |
| 2323 | G4221 | DNA | *G. max* | Predicted polypeptide sequence is paralogous to G4218, G4219, G4220, G4222, G4223, G4224, G4225; orthologous to G207, G227, G230, G242, G4226, G4227, G4228, G4229, G4230, G4231, G4232, G4234, G4235, G4236, G4237, G4238 |
| 2324 | G4221 | PRT | *G. max* | Paralogous to G4218, G4219, G4220, G4222, G4223, G4224, G4225; Orthologous to G207, G227, G230, G242, G4226, G4227, G4228, G4229, G4230, G4231, G4232, G4234, G4235, G4236, G4237, G4238 |
| 2325 | G4222 | DNA | *G. max* | Predicted polypeptide sequence is paralogous to G4218, G4219, G4220, G4221, G4223, G4224, G4225; orthologous to G207, G227, G230, G242, G4226, G4227, G4228, G4229, G4230, G4231, G4232, G4234, G4235, G4236, G4237, G4238 |
| 2326 | G4222 | PRT | *G. max* | Paralogous to G4218, G4219, G4220, G4221, G4223, G4224, G4225; Orthologous to G207, G227, G230, G242, G4226, G4227, G4228, G4229, G4230, G4231, G4232, G4234, G4235, G4236, G4237, G4238 |
| 2327 | G4223 | DNA | *G. max* | Predicted polypeptide sequence is paralogous to G4218, G4219, G4220, G4221, G4222, G4224, G4225; orthologous to G207, G227, G230, G242, G4226, G4227, G4228, G4229, G4230, G4231, G4232, G4234, G4235, G4236, G4237, G4238 |
| 2328 | G4223 | PRT | *G. max* | Paralogous to G4218, G4219, G4220, G4221, G4222, G4224, G4225; Orthologous to G207, G227, G230, G242, G4226, G4227, G4228, G4229, G4230, G4231, G4232, G4234, G4235, G4236, G4237, G4238 |
| 2329 | G4224 | DNA | *G. max* | Predicted polypeptide sequence is paralogous to G4218, G4219, G4220, G4221, G4222, G4223, G4225; orthologous to G207, G227, G230, G242, G4226, G4227, G4228, G4229, G4230, G4231, G4232, G4234, G4235, G4236, G4237, G4238 |
| 2330 | G4224 | PRT | *G. max* | Paralogous to G4218, G4219, G4220, G4221, G4222, G4223, G4225; Orthologous to G207, G227, G230, G242, G4226, G4227, G4228, G4229, G4230, G4231, G4232, G4234, G4235, G4236, G4237, G4238 |
| 2331 | G4225 | DNA | *G. max* | Predicted polypeptide sequence is paralogous to G4218, G4219, G4220, G4221, G4222, G4223, G4224; orthologous to G207, G227, G230, G242, G4226, G4227, G4228, G4229, G4230, G4231, G4232, G4234, G4235, G4236, G4237, G4238 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2332 | G4225 | PRT | G. max | Paralogous to G4218, G4219, G4220, G4221, G4222, G4223, G4224; Orthologous to G207, G227, G230, G242, G4226, G4227, G4228, G4229, G4230, G4231, G4232, G4234, G4235, G4236, G4237, G4238 |
| 2333 | G4226 | DNA | Z. mays | Predicted polypeptide sequence is paralogous to G4227, G4228, G4229, G4230, G4231, G4232; orthologous to G207, G227, G230, G242, G4218, G4219, G4220, G4221, G4222, G4223, G4224, G4225, G4234, G4235, G4236, G4237, G4238 |
| 2334 | G4226 | PRT | Z. mays | Paralogous to G4227, G4228, G4229, G4230, G4231, G4232; Orthologous to G207, G227, G230, G242, G4218, G4219, G4220, G4221, G4222, G4223, G4224, G4225, G4234, G4235, G4236, G4237, G4238 |
| 2335 | G4227 | DNA | Z. mays | Predicted polypeptide sequence is paralogous to G4226, G4228, G4229, G4230, G4231, G4232; orthologous to G207, G227, G230, G242, G4218, G4219, G4220, G4221, G4222, G4223, G4224, G4225, G4234, G4235, G4236, G4237, G4238 |
| 2336 | G4227 | PRT | Z. mays | Paralogous to G4226, G4228, G4229, G4230, G4231, G4232; Orthologous to G207, G227, G230, G242, G4218, G4219, G4220, G4221, G4222, G4223, G4224, G4225, G4234, G4235, G4236, G4237, G4238 |
| 2337 | G4228 | DNA | Z. mays | Predicted polypeptide sequence is paralogous to G4226, G4227, G4229, G4230, G4231, G4232; orthologous to G207, G227, G230, G242, G4218, G4219, G4220, G4221, G4222, G4223, G4224, G4225, G4234, G4235, G4236, G4237, G4238 |
| 2338 | G4228 | PRT | Z. mays | Paralogous to G4226, G4227, G4229, G4230, G4231, G4232; Orthologous to G207, G227, G230, G242, G4218, G4219, G4220, G4221, G4222, G4223, G4224, G4225, G4234, G4235, G4236, G4237, G4238 |
| 2339 | G4229 | DNA | Z. mays | Predicted polypeptide sequence is paralogous to G4226, G4227, G4228, G4230, G4231, G4232; orthologous to G207, G227, G230, G242, G4218, G4219, G4220, G4221, G4222, G4223, G4224, G4225, G4234, G4235, G4236, G4237, G4238 |
| 2340 | G4229 | PRT | Z. mays | Paralogous to G4226, G4227, G4228, G4230, G4231, G4232; Orthologous to G207, G227, G230, G242, G4218, G4219, G4220, G4221, G4222, G4223, G4224, G4225, G4234, G4235, G4236, G4237, G4238 |
| 2341 | G4230 | DNA | Z. mays | Predicted polypeptide sequence is paralogous to G4226, G4227, G4228, G4229, G4231, G4232; orthologous to G207, G227, G230, G242, G4218, G4219, G4220, G4221, G4222, G4223, G4224, G4225, G4234, G4235, G4236, G4237, G4238 |
| 2342 | G4230 | PRT | Z. mays | Paralogous to G4226, G4227, G4228, G4229, G4231, G4232; Orthologous to G207, G227, G230, G242, G4218, G4219, G4220, G4221, G4222, G4223, G4224, G4225, G4234, G4235, G4236, G4237, G4238 |
| 2343 | G4231 | DNA | Z. mays | Predicted polypeptide sequence is paralogous to G4226, G4227, G4228, G4229, G4230, G4232; orthologous to G207, G227, G230, G242, G4218, G4219, G4220, G4221, G4222, G4223, G4224, G4225, G4234, G4235, G4236, G4237, G4238 |
| 2344 | G4231 | PRT | Z. mays | Paralogous to G4226, G4227, G4228, G4229, G4230, G4232; Orthologous to G207, G227, G230, G242, G4218, G4219, G4220, G4221, G4222, G4223, G4224, G4225, G4234, G4235, G4236, G4237, G4238 |
| 2345 | G4232 | DNA | Z. mays | Predicted polypeptide sequence is paralogous to G4226, G4227, G4228, G4229, G4230, G4231; orthologous to G207, G227, G230, G242, G4218, G4219, G4220, G4221, G4222, G4223, G4224, G4225, G4234, G4235, G4236, G4237, G4238 |
| 2346 | G4232 | PRT | Z. mays | Paralogous to G4226, G4227, G4228, G4229, G4230, G4231; Orthologous to G207, G227, G230, G242, G4218, G4219, G4220, G4221, G4222, G4223, G4224, G4225, G4234, G4235, G4236, G4237, G4238 |
| 2347 | G4234 | DNA | O. sativa | Predicted polypeptide sequence is paralogous to G4235, G4236, G4237, G4238; orthologous to G207, G227, G230, G242, G4218, G4219, G4220, G4221, G4222, G4223, G4224, G4225, G4226, G4227, G4228, G4229, G4230, G4231, G4232 |
| 2348 | G4234 | PRT | O. sativa | Paralogous to G4235, G4236, G4237, G4238; Orthologous to G207, G227, G230, G242, G4218, G4219, G4220, G4221, G4222, G4223, G4224, G4225, G4226, G4227, G4228, G4229, G4230, G4231, G4232 |
| 2349 | G4235 | DNA | O. sativa | Predicted polypeptide sequence is paralogous to G4234, G4236, G4237, G4238; orthologous to G207, G227, G230, G242, G4218, G4219, G4220, G4221, G4222, G4223, G4224, G4225, G4226, G4227, G4228, G4229, G4230, G4231, G4232 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2350 | G4235 | PRT | *O. sativa* | Paralogous to G4234, G4236, G4237, G4238; Orthologous to G207, G227, G230, G242, G4218, G4219, G4220, G4221, G4222, G4223, G4224, G4225, G4226, G4227, G4228, G4229, G4230, G4231, G4232 |
| 2351 | G4236 | DNA | *O. sativa* | Predicted polypeptide sequence is paralogous to G4234, G4235, G4237, G4238; orthologous to G207, G227, G230, G242, G4218, G4219, G4220, G4221, G4222, G4223, G4224, G4225, G4226, G4227, G4228, G4229, G4230, G4231, G4232 |
| 2352 | G4236 | PRT | *O. sativa* | Paralogous to G4234, G4235, G4237, G4238; Orthologous to G207, G227, G230, G242, G4218, G4219, G4220, G4221, G4222, G4223, G4224, G4225, G4226, G4227, G4228, G4229, G4230, G4231, G4232 |
| 2353 | G4237 | DNA | *O. sativa* | Predicted polypeptide sequence is paralogous to G4234, G4235, G4236, G4238; orthologous to G207, G227, G230, G242, G4218, G4219, G4220, G4221, G4222, G4223, G4224, G4225, G4226, G4227, G4228, G4229, G4230, G4231, G4232 |
| 2354 | G4237 | PRT | *O. sativa* | Paralogous to G4234, G4235, G4236, G4238; Orthologous to G207, G227, G230, G242, G4218, G4219, G4220, G4221, G4222, G4223, G4224, G4225, G4226, G4227, G4228, G4229, G4230, G4231, G4232 |
| 2355 | G4238 | DNA | *O. sativa* | Predicted polypeptide sequence is paralogous to G4234, G4235, G4236, G4237; orthologous to G207, G227, G230, G242, G4218, G4219, G4220, G4221, G4222, G4223, G4224, G4225, G4226, G4227, G4228, G4229, G4230, G4231, G4232 |
| 2356 | G4238 | PRT | *O. sativa* | Paralogous to G4234, G4235, G4236, G4237; Orthologous to G207, G227, G230, G242, G4218, G4219, G4220, G4221, G4222, G4223, G4224, G4225, G4226, G4227, G4228, G4229, G4230, G4231, G4232 |
| 2357 | G4240 | DNA | *Z. mays* | Predicted polypeptide sequence is orthologous to G1435, G2741, G4241, G4243, G4244, G4245 |
| 2358 | G4240 | PRT | *Z. mays* | Orthologous to G1435, G2741, G4241, G4243, G4244, G4245 |
| 2359 | G4241 | DNA | *O. sativa* | Predicted polypeptide sequence is orthologous to G1435, G2741, G4240, G4243, G4244, G4245 |
| 2360 | G4241 | PRT | *O. sativa* | Orthologous to G1435, G2741, G4240, G4243, G4244, G4245 |
| 2361 | G4243 | DNA | *G. max* | Predicted polypeptide sequence is paralogous to G4244; orthologous to G1435, G2741, G4240, G4241, G4245 |
| 2362 | G4243 | PRT | *G. max* | Paralogous to G4244; Orthologous to G1435, G2741, G4240, G4241, G4245 |
| 2363 | G4244 | DNA | *G. max* | Predicted polypeptide sequence is paralogous to G4243; orthologous to G1435, G2741, G4240, G4241, G4245 |
| 2364 | G4244 | PRT | *G. max* | Paralogous to G4243; Orthologous to G1435, G2741, G4240, G4241, G4245 |
| 2365 | G4245 | DNA | *S. lycopersicum* | Predicted polypeptide sequence is orthologous to G1435, G2741, G4240, G4241, G4243, G4244 |
| 2366 | G4245 | PRT | *S. lycopersicum* | Orthologous to G1435, G2741, G4240, G4241, G4243, G4244 |
| 2367 | G425 | DNA | *A. thaliana* | Predicted polypeptide sequence is paralogous to G2545, G426, G427 |
| 2368 | G425 | PRT | *A. thaliana* | Paralogous to G2545, G426, G427 |
| 2369 | G4253 | DNA | *Z. mays* | Predicted polypeptide sequence is paralogous to G4254, G4255; orthologous to G3074 |
| 2370 | G4253 | PRT | *Z. mays* | Paralogous to G4254, G4255; Orthologous to G3074 |
| 2371 | G4254 | DNA | *Z. mays* | Predicted polypeptide sequence is paralogous to G4253, G4255; orthologous to G3074 |
| 2372 | G4254 | PRT | *Z. mays* | Paralogous to G4253, G4255; Orthologous to G3074 |
| 2373 | G4255 | DNA | *Z. mays* | Predicted polypeptide sequence is paralogous to G4253, G4254; orthologous to G3074 |
| 2374 | G4255 | PRT | *Z. mays* | Paralogous to G4253, G4254; Orthologous to G3074 |
| 2375 | G4256 | DNA | *Z. mays* | Predicted polypeptide sequence is paralogous to G3551, G3552, G4257; orthologous to G489, G714, G3542, G3544, G3545, G3547, G3549, G3550, G3553, G3554, G3555, G3867, G3892, G3893, G3894, G3896 |
| 2376 | G4256 | PRT | *Z. mays* | Paralogous to G3551, G3552, G4257; Orthologous to G489, G714, G3542, G3544, G3545, G3547, G3549, G3550, G3553, G3554, G3555, G3867, G3892, G3893, G3894, G3896 |
| 2377 | G4257 | DNA | *Z. mays* | Predicted polypeptide sequence is paralogous to G3551, G3552, G4256; orthologous to G489, G714, G3542, G3544, G3545, G3547, G3549, G3550, G3553, G3554, G3555, G3867, G3892, G3893, G3894, G3896 |
| 2378 | G4257 | PRT | *Z. mays* | Paralogous to G3551, G3552, G4256; Orthologous to G489, G714, G3542, G3544, G3545, G3547, G3549, G3550, G3553, G3554, G3555, G3867, G3892, G3893, G3894, G3896 |
| 2379 | G4259 | DNA | *Z. mays* | Predicted polypeptide sequence is paralogous to G3889; orthologous to G1646, G715, G3883, G3884, G3885, G3886, G3543 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2380 | G4259 | PRT | Z. mays | Paralogous to G3889; Orthologous to G1646, G715, G3883, G3884, G3885, G3886, G3543 |
| 2381 | G4261 | DNA | Z. mays | Predicted polypeptide sequence is orthologous to G926, G2632, G3924 |
| 2382 | G4261 | PRT | Z. mays | Orthologous to G926, G2632, G3924 |
| 2383 | G4267 | DNA | Z. mays | Predicted polypeptide sequence is paralogous to G4268; orthologous to G2344, G929 |
| 2384 | G4267 | PRT | Z. mays | Paralogous to G4268; Orthologous to G2344, G929 |
| 2385 | G4268 | DNA | Z. mays | Predicted polypeptide sequence is paralogous to G4267; orthologous to G2344, G929 |
| 2386 | G4268 | PRT | Z. mays | Paralogous to G4267; Orthologous to G2344, G929 |
| 2387 | G427 | DNA | A. thaliana | Predicted polypeptide sequence is paralogous to G2545, G425, G426 |
| 2388 | G427 | PRT | A. thaliana | Paralogous to G2545, G425, G426 |
| 2389 | G4272 | DNA | Z. mays | Predicted polypeptide sequence is paralogous to G3434, G3435, G3436, G3437, G3866, G3876, G4276; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2390 | G4272 | PRT | Z. mays | Paralogous to G3434, G3435, G3436, G3437, G3866, G3876, G4276; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2391 | G4276 | DNA | Z. mays | Predicted polypeptide sequence is paralogous to G3434, G3435, G3436, G3437, G3866, G3876, G4272; orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2392 | G4276 | PRT | Z. mays | Paralogous to G3434, G3435, G3436, G3437, G3866, G3876, G4272; Orthologous to G1364, G2345, G481, G482, G485, G3394, G3395, G3396, G3397, G3398, G3429, G3470, G3471, G3472, G3473, G3474, G3475, G3476, G3478, G3868, G3870, G3873, G3874, G3875, G3938 |
| 2393 | G4283 | DNA | Z. mays | Predicted polypeptide sequence is paralogous to G4284; orthologous to G1750, G1421, G4079, G4080, G440, G864, G4285, G4286, G4287, G4288, G4289, G4290, G4291, G4292, G4293 |
| 2394 | G4283 | PRT | Z. mays | Paralogous to G4284; Orthologous to G1750, G1421, G4079, G4080, G440, G864, G4285, G4286, G4287, G4288, G4289, G4290, G4291, G4292, G4293 |
| 2395 | G4284 | DNA | Z. mays | Predicted polypeptide sequence is paralogous to G4283; orthologous to G1750, G1421, G4079, G4080, G440, G864, G4285, G4286, G4287, G4288, G4289, G4290, G4291, G4292, G4293 |
| 2396 | G4284 | PRT | Z. mays | Paralogous to G4283; Orthologous to G1750, G1421, G4079, G4080, G440, G864, G4285, G4286, G4287, G4288, G4289, G4290, G4291, G4292, G4293 |
| 2397 | G4285 | DNA | G. max | Predicted polypeptide sequence is paralogous to G4286, G4287; orthologous to G1750, G1421, G4079, G4080, G440, G864, G4283, G4284, G4288, G4289, G4290, G4291, G4292, G4293 |
| 2398 | G4285 | PRT | G. max | Paralogous to G4286, G4287; Orthologous to G1750, G1421, G4079, G4080, G440, G864, G4283, G4284, G4288, G4289, G4290, G4291, G4292, G4293 |
| 2399 | G4286 | DNA | G. max | Predicted polypeptide sequence is paralogous to G4285, G4287; orthologous to G1750, G1421, G4079, G4080, G440, G864, G4283, G4284, G4288, G4289, G4290, G4291, G4292, G4293 |
| 2400 | G4286 | PRT | G. max | Paralogous to G4285, G4287; Orthologous to G1750, G1421, G4079, G4080, G440, G864, G4283, G4284, G4288, G4289, G4290, G4291, G4292, G4293 |
| 2401 | G4287 | DNA | G. max | Predicted polypeptide sequence is paralogous to G4285, G4286; orthologous to G1750, G1421, G4079, G4080, G440, G864, G4283, G4284, G4288, G4289, G4290, G4291, G4292, G4293 |
| 2402 | G4287 | PRT | G. max | Paralogous to G4285, G4286; Orthologous to G1750, G1421, G4079, G4080, G440, G864, G4283, G4284, G4288, G4289, G4290, G4291, G4292, G4293 |
| 2403 | G4288 | DNA | O. sativa | Predicted polypeptide sequence is paralogous to G4289, G4290, G4291, G4292, G4293; orthologous to G1750, G1421, G4079, G4080, G440, G864, G4283, G4284, G4285, G4286, G4287 |
| 2404 | G4288 | PRT | O. sativa | Paralogous to G4289, G4290, G4291, G4292, G4293; Orthologous to G1750, G1421, G4079, G4080, G440, G864, G4283, G4284, G4285, G4286, G4287 |
| 2405 | G4289 | DNA | O. sativa | Predicted polypeptide sequence is paralogous to G4288, G4290, G4291, G4292, G4293; orthologous to G1750, G1421, G4079, G4080, G440, G864, G4283, G4284, G4285, G4286, G4287 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2406 | G4289 | PRT | O. sativa | Paralogous to G4288, G4290, G4291, G4292, G4293; Orthologous to G1750, G1421, G4079, G4080, G440, G864, G4283, G4284, G4285, G4286, G4287 |
| 2407 | G4290 | DNA | O. sativa | Predicted polypeptide sequence is paralogous to G4288, G4289, G4291, G4292, G4293; orthologous to G1750, G1421, G4079, G4080, G440, G864, G4283, G4284, G4285, G4286, G4287 |
| 2408 | G4290 | PRT | O. sativa | Paralogous to G4288, G4289, G4291, G4292, G4293; Orthologous to G1750, G1421, G4079, G4080, G440, G864, G4283, G4284, G4285, G4286, G4287 |
| 2409 | G4291 | DNA | O. sativa | Predicted polypeptide sequence is paralogous to G4288, G4289, G4290, G4292, G4293; orthologous to G1750, G1421, G4079, G4080, G440, G864, G4283, G4284, G4285, G4286, G4287 |
| 2410 | G4291 | PRT | O. sativa | Paralogous to G4288, G4289, G4290, G4292, G4293; Orthologous to G1750, G1421, G4079, G4080, G440, G864, G4283, G4284, G4285, G4286, G4287 |
| 2411 | G4292 | DNA | O. sativa | Predicted polypeptide sequence is paralogous to G4288, G4289, G4290, G4291, G4293; orthologous to G1750, G1421, G4079, G4080, G440, G864, G4283, G4284, G4285, G4286, G4287 |
| 2412 | G4292 | PRT | O. sativa | Paralogous to G4288, G4289, G4290, G4291, G4293; Orthologous to G1750, G1421, G4079, G4080, G440, G864, G4283, G4284, G4285, G4286, G4287 |
| 2413 | G4293 | DNA | O. sativa | Predicted polypeptide sequence is paralogous to G4288, G4289, G4290, G4291, G4292; orthologous to G1750, G1421, G4079, G4080, G440, G864, G4283, G4284, G4285, G4286, G4287 |
| 2414 | G4293 | PRT | O. sativa | Paralogous to G4288, G4289, G4290, G4291, G4292; Orthologous to G1750, G1421, G4079, G4080, G440, G864, G4283, G4284, G4285, G4286, G4287 |
| 2415 | G4294 | DNA | O. sativa | Predicted polypeptide sequence is orthologous to G1387, G2583, G975 |
| 2416 | G4294 | PRT | O. sativa | Orthologous to G1387, G2583, G975 |
| 2417 | G4306 | DNA | G. max | Predicted polypeptide sequence is orthologous to G233, G241, G4307, G4308, G4309, G4310 |
| 2418 | G4306 | PRT | G. max | Orthologous to G233, G241, G4307, G4308, G4309, G4310 |
| 2419 | G4307 | DNA | S. lycopersicum | Predicted polypeptide sequence is orthologous to G233, G241, G4306, G4308, G4309, G4310 |
| 2420 | G4307 | PRT | S. lycopersicum | Orthologous to G233, G241, G4306, G4308, G4309, G4310 |
| 2421 | G4308 | DNA | O. sativa | Predicted polypeptide sequence is orthologous to G233, G241, G4306, G4307, G4309, G4310 |
| 2422 | G4308 | PRT | O. sativa | Orthologous to G233, G241, G4306, G4307, G4309, G4310 |
| 2423 | G4309 | DNA | Z. mays | Predicted polypeptide sequence is paralogous to G4310; orthologous to G233, G241, G4306, G4307, G4308 |
| 2424 | G4309 | PRT | Z. mays | Paralogous to G4310; Orthologous to G233, G241, G4306, G4307, G4308 |
| 2425 | G4310 | DNA | Z. mays | Predicted polypeptide sequence is paralogous to G4309; orthologous to G233, G241, G4306, G4307, G4308 |
| 2426 | G4310 | PRT | Z. mays | Paralogous to G4309; Orthologous to G233, G241, G4306, G4307, G4308 |
| 2427 | G4311 | DNA | G. max | Predicted polypeptide sequence is paralogous to G4312; orthologous to G3752, G3753, G3751, G793, G591, G3750, G4313 |
| 2428 | G4311 | PRT | G. max | Paralogous to G4312; Orthologous to G3752, G3753, G3751, G793, G591, G3750, G4313 |
| 2429 | G4312 | DNA | G. max | Predicted polypeptide sequence is paralogous to G4311; orthologous to G3752, G3753, G3751, G793, G591, G3750, G4313 |
| 2430 | G4312 | PRT | G. max | Paralogous to G4311; Orthologous to G3752, G3753, G3751, G793, G591, G3750, G4313 |
| 2431 | G4313 | DNA | Z. mays | Predicted polypeptide sequence is paralogous to G3753; orthologous to G3752, G3751, G793, G591, G3750, G4311, G4312 |
| 2432 | G4313 | PRT | Z. mays | Paralogous to G3753; Orthologous to G3752, G3751, G793, G591, G3750, G4311, G4312 |
| 2433 | G4328 | DNA | S. tuberosum | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4329, G4330 |
| 2434 | G4328 | PRT | S. tuberosum | Orthologous to G1791, G1792, G1795, G30, G3380, G3381, G3383, G3515, G3516, G3517, G3518, G3519, G3520, G3735, G3736, G3737, G3794, G3739, G3929, G4329, G4330 |
| 2435 | G4329 | DNA | Petunia x hybrida | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4328, G4330 |
| 2436 | G4329 | PRT | Petunia x hybrida | Orthologous to G1791, G1792, G1795, G30, G3380, G3381, G3383, G3515, G3516, G3517, G3518, G3519, G3520, G3735, G3736, G3737, G3794, G3739, G3929, G4328, G4330 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2437 | G4330 | DNA | *Populus trichocarpa x Populus nigra* | Predicted polypeptide sequence is orthologous to G1791, G1792, G1795, G30, G3380, G3381, G3383, G3515, G3516, G3517, G3518, G3519, G3520, G3735, G3736, G3737, G3794, G3739, G3929, G4328, G4329 |
| 2438 | G4330 | PRT | *Populus trichocarpa x Populus nigra* | Orthologousto G1791, G1792, G1795, G30, G3380, G3381, G3383, G3515, G3516, G3517, G3518, G3519, G3520, G3735, G3736, G3737, G3794, G3739, G3929, G4328, G4329 |
| 2439 | G4369 | DNA | *Z. mays* | Predicted polypeptide sequence is paralogous to G3490, G4370; orthologous to G1543, G3510, G3524, G4371 |
| 2440 | G4369 | PRT | *Z. mays* | Paralogous to G3490, G4370; Orthologous to G1543, G3510, G3524, G4371 |
| 2441 | G4370 | DNA | *Z. mays* | Predicted polypeptide sequence is paralogous to G3490, G4369; orthologous to G1543, G3510, G3524, G4371 |
| 2442 | G4370 | PRT | *Z. mays* | Paralogous to G3490, G4369; Orthologous to G1543, G3510, G3524, G4371 |
| 2443 | G4371 | DNA | *G. max* | Predicted polypeptide sequence is paralogous to G3524; orthologous to G1543, G3510, G3490, G4369, G4370 |
| 2444 | G4371 | PRT | *G. max* | Paralogous to G3524; Orthologous to G1543, G3510, G3490, G4369, G4370 |
| 2445 | G438 | DNA | *A. thaliana* | Predicted polypeptide sequence is paralogous to G1548, G390, G391, G392 |
| 2446 | G438 | PRT | *A. thaliana* | Paralogous to G1548, G390, G391, G392 |
| 2447 | G448 | DNA | *A. thaliana* | Predicted polypeptide sequence is paralogous to G450, G455, G456 |
| 2448 | G448 | PRT | *A. thaliana* | Paralogous to G450, G455, G456 |
| 2449 | G455 | DNA | *A. thaliana* | Predicted polypeptide sequence is paralogous to G448, G450, G456 |
| 2450 | G455 | PRT | *A. thaliana* | Paralogous to G448, G450, G456 |
| 2451 | G456 | DNA | *A. thaliana* | Predicted polypeptide sequence is paralogous to G448, G450, G455 |
| 2452 | G456 | PRT | *A. thaliana* | Paralogous to G448, G450, G455 |
| 2453 | G4570 | DNA | *G. max* | Predicted polypeptide sequence is orthologous to G2157 |
| 2454 | G4570 | PRT | *G. max* | Orthologous to G2157 |
| 2455 | G46 | DNA | *A. thaliana* | Predicted polypeptide sequence is paralogous to G1419, G43, G1004, G29; orthologous to G3849 |
| 2456 | G46 | PRT | *A. thaliana* | Paralogous to G1419, G43, G1004, G29; Orthologous to G3849 |
| 2457 | G4626 | DNA | *S. lycopersicum* | Predicted polypeptide sequence is paralogous to G3841, G3843, G3852; orthologous to G22, G1006, G28, G3430, G3659, G3660, G3661, G3717, G3718, G3844, G3845, G3846, G3848, G3856, G3857, G3858, G3864, G3865, G5171 |
| 2458 | G4626 | PRT | *S. lycopersicum* | Paralogous to G3841, G3843, G3852; Orthologous to G22, G1006, G28, G3430, G3659, G3660, G3661, G3717, G3718, G3844, G3845, G3846, G3848, G3856, G3857, G3858, G3864, G3865, G5171 |
| 2459 | G4627 | DNA | *O. sativa* | Predicted polypeptide sequence is paralogous to G4630, G5158; orthologous to G1809, G557, G4631, G4632 |
| 2460 | G4627 | PRT | *O. sativa* | Paralogous to G4630, G5158; Orthologous to G1809, G557, G4631, G4632 |
| 2461 | G4628 | DNA | *O. sativa* | Predicted polypeptide sequence is orthologous to G1518, G4629, G4633, G4635 |
| 2462 | G4628 | PRT | *O. sativa* | Orthologous to G1518, G4629, G4633, G4635 |
| 2463 | G4629 | DNA | *Pisum sativum* | Predicted polypeptide sequence is orthologous to G1518, G4628, G4633, G4635 |
| 2464 | G4629 | PRT | *Pisum sativum* | Orthologous to G1518, G4628, G4633, G4635 |
| 2465 | G4630 | DNA | *O. sativa* | Predicted polypeptide sequence is paralogous to G4627, G5158; orthologous to G1809, G557, G4631, G4632 |
| 2466 | G4630 | PRT | *O. sativa* | Paralogous to G4627, G5158; Orthologous to G1809, G557, G4631, G4632 |
| 2467 | G4631 | DNA | *G. max* | Predicted polypeptide sequence is orthologous to G1809, G557, G4627, G4630, G4632, G5158 |
| 2468 | G4631 | PRT | *G. max* | Orthologous to G1809, G557, G4627, G4630, G4632, G5158 |
| 2469 | G4632 | DNA | *Z. mays* | Predicted polypeptide sequence is orthologous to G1809, G557, G4627, G4630, G4631, G5158 |
| 2470 | G4632 | PRT | *Z. mays* | Orthologous to G1809, G557, G4627, G4630, G4631, G5158 |
| 2471 | G4633 | DNA | *G. max* | Predicted polypeptide sequence is orthologous to G1518, G4628, G4629, G4635 |
| 2472 | G4633 | PRT | *G. max* | Orthologous to G1518, G4628, G4629, G4635 |
| 2473 | G4635 | DNA | *S. lycopersicum* | Predicted polypeptide sequence is orthologous to G1518, G4628, G4629, G4633 |
| 2474 | G4635 | PRT | *S. lycopersicum* | Orthologous to G1518, G4628, G4629, G4633 |
| 2475 | G4637 | DNA | *Z. mays* | Predicted polypeptide sequence is paralogous to G3531, G3532, G3533, G3534, G4638, G4640; orthologous to G197, G255, G664, G3503, G3504, G3505, G3506, G3507, G3508, G3509, G3529, G3527, G3528, G4639 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2476 | G4637 | PRT | Z. mays | Paralogous to G3531, G3532, G3533, G3534, G4638, G4640; Orthologous to G197, G255, G664, G3503, G3504, G3505, G3506, G3507, G3508, G3509, G3529, G3527, G3528, G4639 |
| 2477 | G4638 | DNA | Z. mays | Predicted polypeptide sequence is paralogous to G3531, G3532, G3533, G3534, G4637, G4640; orthologous to G197, G255, G664, G3503, G3504, G3505, G3506, G3507, G3508, G3509, G3529, G3527, G3528, G4639 |
| 2478 | G4638 | PRT | Z. mays | Paralogous to G3531, G3532, G3533, G3534, G4637, G4640; Orthologous to G197, G255, G664, G3503, G3504, G3505, G3506, G3507, G3508, G3509, G3529, G3527, G3528, G4639 |
| 2479 | G4639 | DNA | G. max | Predicted polypeptide sequence is paralogous to G3529, G3527, G3528; orthologous to G197, G255, G664, G3503, G3504, G3505, G3506, G3507, G3508, G3509, G3531, G3532, G3533, G3534, G4637, G4638, G4640 |
| 2480 | G4639 | PRT | G. max | Paralogous to G3529, G3527, G3528; Orthologous to G197, G255, G664, G3503, G3504, G3505, G3506, G3507, G3508, G3509, G3531, G3532, G3533, G3534, G4637, G4638, G4640 |
| 2481 | G464 | DNA | A. thaliana | Predicted polypeptide sequence is paralogous to G463 |
| 2482 | G464 | PRT | A. thaliana | Paralogous to G463 |
| 2483 | G4640 | DNA | Z. mays | Predicted polypeptide sequence is paralogous to G3531, G3532, G3533, G3534, G4637, G4638; orthologous to G197, G255, G664, G3503, G3504, G3505, G3506, G3507, G3508, G3509, G3529, G3527, G3528, G4639 |
| 2484 | G4640 | PRT | Z. mays | Paralogous to G3531, G3532, G3533, G3534, G4637, G4638; Orthologous to G197, G255, G664, G3503, G3504, G3505, G3506, G3507, G3508, G3509, G3529, G3527, G3528, G4639 |
| 2485 | G472 | DNA | A. thaliana | Predicted polypeptide sequence is paralogous to G1553, G716 |
| 2486 | G472 | PRT | A. thaliana | Paralogous to G1553, G716 |
| 2487 | G502 | DNA | A. thaliana | Predicted polypeptide sequence is paralogous to G501, G519, G767 |
| 2488 | G502 | PRT | A. thaliana | Paralogous to G501, G519, G767 |
| 2489 | G514 | DNA | A. thaliana | Predicted polypeptide sequence is paralogous to G523, G525, G764 |
| 2490 | G514 | PRT | A. thaliana | Paralogous to G523, G525, G764 |
| 2491 | G515 | DNA | A. thaliana | Predicted polypeptide sequence is paralogous to G2053, G516, G517 |
| 2492 | G515 | PRT | A. thaliana | Paralogous to G2053, G516, G517 |
| 2493 | G5158 | DNA | O. sativa | Predicted polypeptide sequence is paralogous to G4627, G4630; orthologous to G1809, G557, G4631, G4632 |
| 2494 | G5158 | PRT | O. sativa | Paralogous to G4627, G4630; Orthologous to G1809, G557, G4631, G4632 |
| 2495 | G5159 | DNA | O. sativa | Predicted polypeptide sequence is orthologous to G1482, G1888 |
| 2496 | G5159 | PRT | O. sativa | Orthologous to G1482, G1888 |
| 2497 | G516 | DNA | A. thaliana | Predicted polypeptide sequence is paralogous to G2053, G515, G517 |
| 2498 | G516 | PRT | A. thaliana | Paralogous to G2053, G515, G517 |
| 2499 | G517 | DNA | A. thaliana | Predicted polypeptide sequence is paralogous to G2053, G515, G516 |
| 2500 | G517 | PRT | A. thaliana | Paralogous to G2053, G515, G516 |
| 2501 | G5170 | DNA | S. lycopersicum | Predicted polypeptide sequence is orthologous to G1266, G5184, G5185, G5186 |
| 2502 | G5170 | PRT | S. lycopersicum | Orthologous to G1266, G5184, G5185, G5186 |
| 2503 | G5171 | DNA | O. sativa | Predicted polypeptide sequence is paralogous to G3430, G3848; orthologous to G22, G1006, G28, G3659, G3660, G3661, G3717, G3718, G3841, G3843, G3844, G3845, G3846, G3852, G3856, G3857, G3858, G3864, G3865, G4626 |
| 2504 | G5171 | PRT | O. sativa | Paralogous to G3430, G3848; Orthologous to G22, G1006, G28, G3659, G3660, G3661, G3717, G3718, G3841, G3843, G3844, G3845, G3846, G3852, G3856, G3857, G3858, G3864, G3865, G4626 |
| 2505 | G5184 | DNA | G. max | Predicted polypeptide sequence is paralogous to G5186; orthologous to G1266, G5185, G5170 |
| 2506 | G5184 | PRT | G. max | Paralogous to G5186; Orthologous to G1266, G5185, G5170 |
| 2507 | G5185 | DNA | Z. mays | Predicted polypeptide sequence is orthologous to G1266, G5184, G5186, G5170 |
| 2508 | G5185 | PRT | Z. mays | Orthologous to G1266, G5184, G5186, G5170 |
| 2509 | G5186 | DNA | G. max | Predicted polypeptide sequence is paralogous to G5184; orthologous to G1266, G5185, G5170 |
| 2510 | G5186 | PRT | G. max | Paralogous to G5184; Orthologous to G1266, G5185, G5170 |
| 2511 | G521 | DNA | A. thaliana | Predicted polypeptide sequence is paralogous to G2887 |
| 2512 | G521 | PRT | A. thaliana | Paralogous to G2887 |
| 2513 | G523 | DNA | A. thaliana | Predicted polypeptide sequence is paralogous to G514, G525, G764 |
| 2514 | G523 | PRT | A. thaliana | Paralogous to G514, G525, G764 |
| 2515 | G524 | DNA | A. thaliana | Predicted polypeptide sequence is paralogous to G763 |
| 2516 | G524 | PRT | A. thaliana | Paralogous to G763 |
| 2517 | G528 | DNA | A. thaliana | Predicted polypeptide sequence is paralogous to G529, G530, G531, G532, G533, G534, G535, G536, G537 |

237
238

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2518 | G528 | PRT | A. thaliana | Paralogous to G529, G530, G531, G532, G533, G534, G535, G536, G537 |
| 2519 | G533 | DNA | A. thaliana | Predicted polypeptide sequence is paralogous to G528, G529, G530, G531, G532, G534, G535, G536, G537 |
| 2520 | G533 | PRT | A. thaliana | Paralogous to G528, G529, G530, G531, G532, G534, G535, G536, G537 |
| 2521 | G534 | DNA | A. thaliana | Predicted polypeptide sequence is paralogous to G528, G529, G530, G531, G532, G533, G535, G536, G537 |
| 2522 | G534 | PRT | A. thaliana | Paralogous to G528, G529, G530, G531, G532, G533, G535, G536, G537 |
| 2523 | G535 | DNA | A. thaliana | Predicted polypeptide sequence is paralogous to G528, G529, G530, G531, G532, G533, G534, G536, G537 |
| 2524 | G535 | PRT | A. thaliana | Paralogous to G528, G529, G530, G531, G532, G533, G534, G536, G537 |
| 2525 | G536 | DNA | A. thaliana | Predicted polypeptide sequence is paralogous to G528, G529, G530, G531, G532, G533, G534, G535, G537 |
| 2526 | G536 | PRT | A. thaliana | Paralogous to G528, G529, G530, G531, G532, G533, G534, G535, G537 |
| 2527 | G537 | DNA | A. thaliana | Predicted polypeptide sequence is paralogous to G528, G529, G530, G531, G532, G533, G534, G535, G536 |
| 2528 | G537 | PRT | A. thaliana | Paralogous to G528, G529, G530, G531, G532, G533, G534, G535, G536 |
| 2529 | G545 | DNA | A. thaliana | Predicted polypeptide sequence is paralogous to G350, G351 |
| 2530 | G545 | PRT | A. thaliana | Paralogous to G350, G351 |
| 2531 | G554 | DNA | A. thaliana | Predicted polypeptide sequence is paralogous to G1198, G1806, G555, G556, G558, G578, G629 |
| 2532 | G554 | PRT | A. thaliana | Paralogous to G1198, G1806, G555, G556, G558, G578, G629 |
| 2533 | G555 | DNA | A. thaliana | Predicted polypeptide sequence is paralogous to G1198, G1806, G554, G556, G558, G578, G629 |
| 2534 | G555 | PRT | A. thaliana | Paralogous to G1198, G1806, G554, G556, G558, G578, G629 |
| 2535 | G557 | DNA | A. thaliana | Predicted polypeptide sequence is paralogous to G1809; orthologous to G4627, G4630, G4631, G4632, G5158 |
| 2536 | G557 | PRT | A. thaliana | Paralogous to G1809; Orthologous to G4627, G4630, G4631, G4632, G5158 |
| 2537 | G561 | DNA | A. thaliana | Predicted polypeptide sequence is paralogous to G562 |
| 2538 | G561 | PRT | A. thaliana | Paralogous to G562 |
| 2539 | G578 | DNA | A. thaliana | Predicted polypeptide sequence is paralogous to G1198, G1806, G554, G555, G556, G558, G629 |
| 2540 | G578 | PRT | A. thaliana | Paralogous to G1198, G1806, G554, G555, G556, G558, G629 |
| 2541 | G584 | DNA | A. thaliana | Predicted polypeptide sequence is paralogous to G1136 |
| 2542 | G584 | PRT | A. thaliana | Paralogous to G1136 |
| 2543 | G589 | DNA | A. thaliana | Predicted polypeptide sequence is paralogous to G1061, G2791; orthologous to G3748, G3749, G3774, G3760 |
| 2544 | G589 | PRT | A. thaliana | Paralogous to G1061, G2791; Orthologous to G3748, G3749, G3774, G3760 |
| 2545 | G593 | DNA | A. thaliana | Predicted polypeptide sequence is paralogous to G790 |
| 2546 | G593 | PRT | A. thaliana | Paralogous to G790 |
| 2547 | G602 | DNA | A. thaliana | Predicted polypeptide sequence is paralogous to G1065 |
| 2548 | G602 | PRT | A. thaliana | Paralogous to G1065 |
| 2549 | G605 | DNA | A. thaliana | Predicted polypeptide sequence is paralogous to G1944 |
| 2550 | G605 | PRT | A. thaliana | Paralogous to G1944 |
| 2551 | G617 | DNA | A. thaliana | Predicted polypeptide sequence is paralogous to G2650 |
| 2552 | G617 | PRT | A. thaliana | Paralogous to G2650 |
| 2553 | G618 | DNA | A. thaliana | Predicted polypeptide sequence is paralogous to G2057 |
| 2554 | G618 | PRT | A. thaliana | Paralogous to G2057 |
| 2555 | G620 | DNA | A. thaliana | Predicted polypeptide sequence is paralogous to G1821; orthologous to G3839, G3937, G3939 |
| 2556 | G620 | PRT | A. thaliana | Paralogous to G1821; Orthologous to G3839, G3937, G3939 |
| 2557 | G627 | DNA | A. thaliana | Predicted polypeptide sequence is paralogous to G149, G1011, G154, G1797, G1798; orthologous to G4061, G4062, G4063, G4064, G4065, G4066, G4067 |
| 2558 | G627 | PRT | A. thaliana | Paralogous to G149, G1011, G154, G1797, G1798; Orthologous to G4061, G4062, G4063, G4064, G4065, G4066, G4067 |
| 2559 | G629 | DNA | A. thaliana | Predicted polypeptide sequence is paralogous to G1198, G1806, G554, G555, G556, G558, G578 |
| 2560 | G629 | PRT | A. thaliana | Paralogous to G1198, G1806, G554, G555, G556, G558, G578 |
| 2561 | G632 | DNA | A. thaliana | Predicted polypeptide sequence is paralogous to G1559 |
| 2562 | G632 | PRT | A. thaliana | Paralogous to G1559 |
| 2563 | G652 | DNA | A. thaliana | Predicted polypeptide sequence is paralogous to G1335 |
| 2564 | G652 | PRT | A. thaliana | Paralogous to G1335 |
| 2565 | G654 | DNA | A. thaliana | Predicted polypeptide sequence is paralogous to G653 |
| 2566 | G654 | PRT | A. thaliana | Paralogous to G653 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2567 | G668 | DNA | A. thaliana | Predicted polypeptide sequence is paralogous to G256, G666, G932; orthologous to G3384, G3385, G3386, G3500, G3501, G3502, G3537, G3538, G3539, G3540, G3541 |
| 2568 | G668 | PRT | A. thaliana | Paralogous to G256, G666, G932; Orthologous to G3384, G3385, G3386, G3500, G3501, G3502, G3537, G3538, G3539, G3540, G3541 |
| 2569 | G670 | DNA | A. thaliana | Predicted polypeptide sequence is paralogous to G1319 |
| 2570 | G670 | PRT | A. thaliana | Paralogous to G1319 |
| 2571 | G678 | DNA | A. thaliana | Predicted polypeptide sequence is paralogous to G229 |
| 2572 | G678 | PRT | A. thaliana | Paralogous to G229 |
| 2573 | G713 | DNA | A. thaliana | Predicted polypeptide sequence is paralogous to G413 |
| 2574 | G713 | PRT | A. thaliana | Paralogous to G413 |
| 2575 | G716 | DNA | A. thaliana | Predicted polypeptide sequence is paralogous to G1553, G472 |
| 2576 | G716 | PRT | A. thaliana | Paralogous to G1553, G472 |
| 2577 | G729 | DNA | A. thaliana | Predicted polypeptide sequence is paralogous to G1040, G3034, G730 |
| 2578 | G729 | PRT | A. thaliana | Paralogous to G1040, G3034, G730 |
| 2579 | G760 | DNA | A. thaliana | Predicted polypeptide sequence is paralogous to G3041 |
| 2580 | G760 | PRT | A. thaliana | Paralogous to G3041 |
| 2581 | G761 | DNA | A. thaliana | Predicted polypeptide sequence is paralogous to G1354, G1355, G1453, G1766, G2534, G522 |
| 2582 | G761 | PRT | A. thaliana | Paralogous to G1354, G1355, G1453, G1766, G2534, G522 |
| 2583 | G767 | DNA | A. thaliana | Predicted polypeptide sequence is paralogous to G501, G502, G519 |
| 2584 | G767 | PRT | A. thaliana | Paralogous to G501, G502, G519 |
| 2585 | G791 | DNA | A. thaliana | Predicted polypeptide sequence is paralogous to G792 |
| 2586 | G791 | PRT | A. thaliana | Paralogous to G792 |
| 2587 | G807 | DNA | A. thaliana | Predicted polypeptide sequence is paralogous to G810; orthologous to G3491, G3494, G3495, G3512 |
| 2588 | G807 | PRT | A. thaliana | Paralogous to G810; Orthologous to G3491, G3494, G3495, G3512 |
| 2589 | G820 | DNA | A. thaliana | Predicted polypeptide sequence is paralogous to G268, G2876 |
| 2590 | G820 | PRT | A. thaliana | Paralogous to G268, G2876 |
| 2591 | G833 | DNA | A. thaliana | Predicted polypeptide sequence is paralogous to G274 |
| 2592 | G833 | PRT | A. thaliana | Paralogous to G274 |
| 2593 | G852 | DNA | A. thaliana | Predicted polypeptide sequence is paralogous to G1768, G2633, G2697, G313; orthologous to G3815, G3825 |
| 2594 | G852 | PRT | A. thaliana | Paralogous to G1768, G2633, G2697, G313; Orthologous to G3815, G3825 |
| 2595 | G859 | DNA | A. thaliana | Predicted polypeptide sequence is paralogous to G157, G1759, G1842, G1843, G1844 |
| 2596 | G859 | PRT | A. thaliana | Paralogous to G157, G1759, G1842, G1843, G1844 |
| 2597 | G860 | DNA | A. thaliana | Predicted polypeptide sequence is paralogous to G152, G153, G1760; orthologous to G3479, G3480, G3481, G3482, G3483, G3484, G3485, G3487, G3488, G3489, G3980, G3981, G3982 |
| 2598 | G860 | PRT | A. thaliana | Paralogous to G152, G153, G1760; Orthologous to G3479, G3480, G3481, G3482, G3483, G3484, G3485, G3487, G3488, G3489, G3980, G3981, G3982 |
| 2599 | G861 | DNA | A. thaliana | Predicted polypeptide sequence is paralogous to G1140; orthologous to G3984, G3985, G3986, G3987, G3988, G3989, G3990, G3991, G3992, G3998, G3999, G4060 |
| 2600 | G861 | PRT | A. thaliana | Paralogous to G1140; Orthologous to G3984, G3985, G3986, G3987, G3988, G3989, G3990, G3991, G3992, G3998, G3999, G4060 |
| 2601 | G864 | DNA | A. thaliana | Predicted polypeptide sequence is paralogous to G1750, G1421, G440; orthologous to G4079, G4080, G4283, G4284, G4285, G4286, G4287, G4288, G4289, G4290, G4291, G4292, G4293 |
| 2602 | G864 | PRT | A. thaliana | Paralogous to G1750, G1421, G440; Orthologous to G4079, G4080, G4283, G4284, G4285, G4286, G4287, G4288, G4289, G4290, G4291, G4292, G4293 |
| 2603 | G867 | DNA | A. thaliana | Predicted polypeptide sequence is paralogous to G1930, G9, G993; orthologous to G3388, G3389, G3390, G3391, G3432, G3433, G3451, G3452, G3453, G3454, G3455 |
| 2604 | G867 | PRT | A. thaliana | Paralogous to G1930, G9, G993; Orthologous to G3388, G3389, G3390, G3391, G3432, G3433, G3451, G3452, G3453, G3454, G3455 |
| 2605 | G899 | DNA | A. thaliana | Predicted polypeptide sequence is paralogous to G1480, G897 |
| 2606 | G899 | PRT | A. thaliana | Paralogous to G1480, G897 |
| 2607 | G9 | DNA | A. thaliana | Predicted polypeptide sequence is paralogous to G1930, G867, G993; orthologous to G3388, G3389, G3390, G3391, G3432, G3433, G3451, G3452, G3453, G3454, G3455 |
| 2608 | G9 | PRT | A. thaliana | Paralogous to G1930, G867, G993; Orthologous to G3388, G3389, G3390, G3391, G3432, G3433, G3451, G3452, G3453, G3454, G3455 |
| 2609 | G903 | DNA | A. thaliana | Predicted polypeptide sequence is paralogous to G2831 |
| 2610 | G903 | PRT | A. thaliana | Paralogous to G2831 |

TABLE 8-continued

Putative homologs of *Arabidopsis* transcription factor genes identified using BLAST analysis

| Col. 1 SEQ ID NO: | Col. 2 GID | Col. 3 DNA or PRT | Col. 4 Species | Col. 5 Relationship |
|---|---|---|---|---|
| 2611 | G911 | DNA | A. thaliana | Predicted polypeptide sequence is paralogous to G1113 |
| 2612 | G911 | PRT | A. thaliana | Paralogous to G1113 |
| 2613 | G912 | DNA | A. thaliana | Predicted polypeptide sequence is paralogous to G40, G2107, G2513, G41, G42; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2614 | G912 | PRT | A. thaliana | Paralogous to G40, G2107, G2513, G41, G42; Orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3443, G3463, G3464, G3465, G3466, G3467, G3468, G3469 |
| 2615 | G913 | DNA | A. thaliana | Predicted polypeptide sequence is paralogous to G2514, G976, G1753 |
| 2616 | G913 | PRT | A. thaliana | Paralogous to G2514, G976, G1753 |
| 2617 | G925 | DNA | A. thaliana | Predicted polypeptide sequence is paralogous to G2371 |
| 2618 | G925 | PRT | A. thaliana | Paralogous to G2371 |
| 2619 | G926 | DNA | A. thaliana | Predicted polypeptide sequence is paralogous to G2632; orthologous to G3924, G4261 |
| 2620 | G926 | PRT | A. thaliana | Paralogous to G2632; Orthologous to G3924, G4261 |
| 2621 | G932 | DNA | A. thaliana | Predicted polypeptide sequence is paralogous to G256, G666, G668; orthologous to G3384, G3385, G3386, G3500, G3501, G3502, G3537, G3538, G3539, G3540, G3541 |
| 2622 | G932 | PRT | A. thaliana | Paralogous to G256, G666, G668; Orthologous to G3384, G3385, G3386, G3500, G3501, G3502, G3537, G3538, G3539, G3540, G3541 |
| 2623 | G940 | DNA | A. thaliana | Predicted polypeptide sequence is paralogous to G938, G941 |
| 2624 | G940 | PRT | A. thaliana | Paralogous to G938, G941 |
| 2625 | G957 | DNA | A. thaliana | Predicted polypeptide sequence is paralogous to G2535, G961 |
| 2626 | G957 | PRT | A. thaliana | Paralogous to G2535, G961 |
| 2627 | G960 | DNA | A. thaliana | Predicted polypeptide sequence is paralogous to G1426, G1455, G513 |
| 2628 | G960 | PRT | A. thaliana | Paralogous to G1426, G1455, G513 |
| 2629 | G964 | DNA | A. thaliana | Predicted polypeptide sequence is paralogous to G398, G399 |
| 2630 | G964 | PRT | A. thaliana | Paralogous to G398, G399 |
| 2631 | G986 | DNA | A. thaliana | Predicted polypeptide sequence is paralogous to G881 |
| 2632 | G986 | PRT | A. thaliana | Paralogous to G881 |
| 2633 | G990 | DNA | A. thaliana | Predicted polypeptide sequence is paralogous to G1451 |
| 2634 | G990 | PRT | A. thaliana | Paralogous to G1451 |

Example IX

Introduction of Polynucleotides into Dicotyledonous and Monocotyledonous Plants

Transcription factor sequences listed in the Sequence Listing recombined into expression vectors, such as pMEN20 or pMEN65, may be transformed into a plant for the purpose of modifying plant traits. It is now routine to produce transgenic plants using most dicot plants (see Weissbach and Weissbach, (1989); Gelvin et al. (1990); Herrera-Estrella et al. (1983); Bevan (1984); and Klee (1985)). Methods for analysis of traits are routine in the art and examples are disclosed above.

The cloning vectors of the invention may also be introduced into a variety of grasses (e.g., Switchgrass, *Miscanthus*, cane, or *Miscanthus*-cane hybrids), or cereal plants. Cereal plants such as, but not limited to, corn, wheat, rice, sorghum, or barley, may also be transformed with the present polynucleotide sequences in pMEN20 or pMEN65 expression vectors for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of monocots by means well known in the art such as, for example, direct DNA transfer or *Agrobacterium tumefaciens*-mediated transformation. It is now routine to produce transgenic plants of most cereal crops (Vasil (1994)) such as corn, wheat, rice, sorghum (Cassas et al. (1993)), and barley (Wan and Lemeaux (1994)). DNA transfer methods such as the microprojectile can be used for corn (Fromm et al. (1990); Gordon-Kamm et al. (1990); Ishida (1990)), wheat (Vasil et al. (1992); Vasil et al. (1993b); Weeks et al. (1993)), and rice (Christou (1991); Hiei et al. (1994); Aldemita and Hodges (1996); and Hiei et al. (1997)). For most cereal plants, embryogenic cells derived from immature scutellum tissues are the preferred cellular targets for transformation (Hiei et al. (1997); Vasil (1994)).

Vectors according to the present invention may be transformed into corn embryogenic cells derived from immature scutellar tissue by using microprojectile bombardment, with the A188XB73 genotype as the preferred genotype (Fromm et al. (1990); Gordon-Kamm et al. (1990)). After microprojectile bombardment the tissues are selected on phosphinothricin to identify the transgenic embryogenic cells (Gordon-Kamm et al. (1990)). Transgenic plants are regenerated by standard corn regeneration techniques (Fromm et al. (1990); Gordon-Kamm et al. (1990)).

The vectors prepared as described above can also be used to produce transgenic wheat and rice plants (Christou (1991); Hiei et al. (1994); Aldemita and Hodges (1996); and Hiei et al. (1997)) that coordinately express genes of interest by following standard transformation protocols known to those skilled in the art for rice and wheat (Vasil et al. (1992); Vasil et al. (1993); and Weeks et al. (1993)), where the bar gene is used as the selectable marker.

Example X

Genes that Confer Significant Improvements to Diverse Plant Species

The function of specific orthologs of the sequences of the invention may be further characterized and incorporated into crop plants. The ectopic overexpression of these orthologs may be regulated using constitutive, inducible, or tissue specific regulatory elements. Genes that have been examined and have been shown to modify plant traits (including increasing lycopene, soluble solids and disease tolerance) encode orthologs of the transcription factor polypeptides found in the Sequence Listing, Table 7 or Table 8. In addition to these sequences, it is expected that related polynucleotide sequences encoding polypeptides found in the Sequence Listing can also induce altered traits, including increasing lycopene, soluble solids and disease tolerance, when transformed into a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

Transgenic plants are subjected to assays to measure plant volume, lycopene, soluble solids, disease tolerance, and fruit set according to the methods disclosed in the above Examples.

These experiments demonstrate that a significant number the transcription factor polypeptide sequences of the invention can be identified and shown to increased volume, lycopene, soluble solids and disease tolerance. It is expected that the same methods may be applied to identify and eventually make use of other members of the clades of the present transcription factor polypeptides, with the transcription factor polypeptides deriving from a diverse range of species.

REFERENCES CITED

Aldemita and Hodges (11996) *Planta* 199:612-617
Ainley et al. (11993) *Plant Mol. Biol.* 22: 13-23
Altschul et al. (1990) *J. Mol. Biol.* 215: 403-410
Altschul (1993) *J. Mol. Evol.* 36: 290-300
Ammirato et al., eds. (1984) *Handbook of Plant Cell Culture—Crop Species*, Macmillan Publ. Co., NY
An et al. (11988) *Plant Physiol.* 88: 547-552
Anderson and Young (1985) "Quantitative Filter Hybridisation." In: Hames and Higgins, ed., *Nucleic Acid Hybridisation, A Practical Approach*. Oxford, TRL Press, 73-111
Angiosperm Phylogeny Group (1998) *Ann. Missouri Bot. Gard.* 84: 1-49
Aoyama et al. (11995) *Plant Cell* 7: 1773-1785
Ausubel et al. (11997) *Short Protocols in Molecular Biology*, John Wiley & Sons, New York, N.Y., unit 7.7
Ausubel et al., eds. (11998-2000) *Current Protocols in Molecular Biology*, Greene Publishing Associates, Inc. and John Wiley & Sons, Inc., (supplemented through 2000) ("Ausubel")
Baerson et al. (11993) *Plant Mol. Biol.* 22: 255-267
Baerson et al. (11994) *Plant Mol. Biol.* 26: 1947-1959
Bairoch et al. (11997) *Nucleic Acids Res.* 25: 217-221
Baumann et al., (1999) *Plant Cell* 11: 323-334
Beaucage et al. (11981) *Tetrahedron Letters* 22: 1859-1869
Berger and Kimmel (1987) *Guide to Molecular Cloning Techniques, Methods in Enzymology*, vol. 152 Academic Press, Inc., San Diego, Calif. ("Berger and Kimmel")
Bevan (11984) *Nucleic Acids Res.* 12: 8711-8721
Bhattacharjee et al. (2001) *Proc Natl. Acad. Sci.*, USA, 98: 13790-13795
Bird et al. (1988) *Plant Mol. Biol.* 11: 651-662
Borevitz et al. (2000) *Plant Cell* 12: 2383-2394
Boss and Thomas (2002) *Nature*, 416: 847-850
Breen and Crouch (11992) *Plant Mol. Biol.* 19:1049-1055
Bruce et al. (2000) *Plant Cell*, 12: 65-79
Buchel et al. (1999) *Plant Mol. Biol.* 40: 387-396
Bulyk et al. (11999) *Nature Biotechnol.* 17: 573-577
Brummelkamp et al. (2002) *Science* 296:550-553
Byrne et al (2000) *Nature* 408: 967-971
Cassas et al. (11993) *Proc. Natl. Acad. Sci.* 90: 11212-11216
Chase et al. (1993) *Ann. Missouri Bot. Gard.* 80: 528-580
Cheng et al. (1994) *Nature* 369: 684-685
Chien et al. (1991) *Proc. Natl. Acad. Sci.* 88: 9578-9582
Chrispeels et al. (2000) *Plant Mol. Biol.* 42: 279-290
Christou (1991) *Bio/Technology* 9: 957-962
Constans (2002) *The Scientist* 16: 36
Corona et al. (1996) *Plant J.* 9: 505-512
Coupland (1995) *Nature* 377: 482-483
Crowley et al. (1985) *Cell* 43: 633-641
Daly et al. (2001) *Plant Physiol* 127: 1328-1333
Doolittle, ed., (1996) *Methods Enzymol*, vol. 266, "Computer Methods for Macromolecular Sequence Analysis", Academic Press, Inc., San Diego, Calif., USA
Eddy (1996) *Curr. Opin. Str. Biol.* 6: 361-365
Eisen (1998) *Genome Res.* 8: 163-167
Eyal et al. (1992) *Plant Mol. Biol.* 19: 589-599
Feng and Doolittle (1987) *J. Mol. Evol.* 25: 351-360
Fire et al. (1998) *Nature* 391: 806-811
Fluhr et al (1986) *EMBO J.* 5: 2063-2071
Fowler and Thomashow (2002) *Plant Cell* 14: 1675-1690
Fraley et al. (1983) *Proc. Natl. Acad. Sci.* 80: 4803-4807
Fromm et al. (1985) *Proc. Natl. Acad. Sci.* 82: 5824-5828
Fromm et al. (1989) *Plant Cell* 1: 977-984
Fromm et al. (1990) *Bio/Technol* 8: 833-839
Fu et al. (2001) *Plant Cell* 13: 1791-1802
Gan and Amasino (1995) *Science* 270: 1986-1988)
Gatz (1997) *Annu. Rev. Plant Physiol. Plant Mol. Biol.* 48: 89-108
Gelvin et al. (1990) *Plant Molecular Biology Manual*, Kluwer Academic Publishers
Giniger and Ptashne (1987) *Nature* 330: 670-672
Gilmour et al. (1998) *Plant J.* 16: 433-442
Goodrich et al. (1993) *Cell* 75: 519-530
Gordon-Kamm (1990) *Plant Cell* 2: 603-618
Guevara-Garcia (1998) *Plant Mol Biol* 38: 743-753
Guyer et al. (1998) *Genetics* 149: 633-639
Hames and Higgins, eds. (1985) *Nucleic Acid Hybridisation: A Practical Approach*, IRL Press, Oxford, U. K.
Hammond et al. (2001) *Nature Rev Gen* 2: 110-119
Harlow and Lane (1988), *Antibodies: A Laboratory Manual*, Cold Spring Harbor Laboratory, New York
He et al. (2000) *Transgenic Res.* 9: 223-227

Hein (1990) *Methods Enzymol.* 183: 626-645
Hempel et al. (1997) *Development* 124: 3845-3853
Henikoff and Henikoff (1991) *Nucleic Acids Res.* 19: 6565-6572
Henikoff and Henikoff (1992) *Proc. Natl. Acad. Sci.* 89: 10915-10919
Herrera-Estrella et al. (1983) *Nature* 303: 209
Hiei et al. (1994) *Plant J.* 6:271-282
Hiei et al. (1997) *Plant Mol. Biol.* 35:205-218
Higgins and Sharp (1988) *Gene* 73: 237-244
Higgins et al. (1996) *Methods Enzymol* 266: 383-402
Hohn et al. (1982) *Molecular Biology of Plant Tumors Academic Press*, New York, N.Y., pp. 549-560
Horsch et al. (1984) *Science* 233: 496-498
Ichikawa et al. (1997) *Nature* 390 698-701
Isalan et al. (2001) *Nature Biotechnol.* 19: 656-660
Ishida (1990) *Nature Biotechnol* 14:745-750
Ishida et al. (1996) *Nature Biotechnol* 14: 745-750
Izant and Weintraub (1985) *Science* 229: 345-352
Jaglo et al. (2001) *Plant Physiol.* 127: 910-917
Jones et al. (1992) *Transgenic Res.* 1: 285-297
Kaiser et al. (1995) *Plant Mol. Biol.* 28: 231-243
Kakimoto et al. (1996) *Science* 274: 982-985
Karlin and Altschul (1993) *Proc. Natl. Acad. Sci.* 90: 5873-5787
Kashima et al. (1985) *Nature* 313:402-404
Kempin et al. (1997) *Nature* 389: 802-803
Kim and Wold (1985) *Cell* 42: 129-138
Kim et al. (2001) *Plant J.* 25: 247-259
Kimmel (1987) *Methods Enzymo.* 152: 507-511
Klee (1985) *Bio/Technology* 3: 637-642
Klein et al. (1987) *Nature* 327: 70-73
Koncz et al. (1992a) *Methods in Arabidopsis Research*, World Scientific, River Edge, N.J.
Koncz et al (1992b) *Plant Molec. Biol.* 20: 963-976
Kop et al. (1999) *Plant Mol Biol* 39: 979-990
Ku et al. (2000) *Proc. Natl. Acad. Sci.* 97: 9121-9126
Kuhlemeier et al. (1989) *Plant Cell* 1: 471-478
Kyozuka and Shimamoto (2002) *Plant Cell Physiol.* 43: 130-135
Lehming et al (1987) *EMBO J.* 6: 3145-3153
Lichtenstein and Nellen (1997) *Antisense Technology: A Practical Approach* IRL Press at Oxford University Press, Oxford, U.K
Lin et al. (1991) *Nature* 353: 569-571
Liu et al. (2001) *J. Biol. Chem.* 276: 11323-11334
Long and Barton (1998) *Development* 125: 3027-3035
Long and Barton (2000) *Dev. Biol.* 218: 341-353
Ma and Ptashne (1987) *Cell* 51: 113-119
Mandel et al. (1992a) *Nature* 360: 273-277
Mandel et al. (1992b) *Cell* 71: 133-143
Manners et al. (1998) *Plant Mol. Biol.* 38: 1071-1080
Matthes et al. (1984) *EMBO J.* 3: 801-805
Melton (1985) *Proc. Natl. Acad. Sci.* 82: 144-148
Meyers (1995) *Molecular Biology and Biotechnology*, Wiley VCH, New York, N.Y., p 856-853
Montgomery et al. (1993) *Plant Cell* 5: 1049-1062
Moore et al. (1988) in Schaad, ed., Laboratory Guide for the Identification of Plant Pathogenic Bacteria. APS Press, St. Paul, Minn.
Moore et al. (1998) *Proc. Natl. Acad. Sci.* 95: 376-381
Mount (2001) in *Bioinformatics: Sequence and Genome Analysis* Cold Spring Harbor Laboratory Press, Cold Spring Harbor, N.Y., page 543
Müller et al. (2001) *Plant J.* 28: 169-179
Mullis et al. (1990) *PCR Protocols A Guide to Methods and Applications* (Innis et al. eds) Academic Press Inc. San Diego, Calif.
Murashige and Skoog (1962) *Plant Physiol.* 15: 473-497
Nagel et al. (1990) *FEMS Microbiol. Letts.* 67: 325-328
Nandi et al. (2000) *Curr. Biol.* 10: 215-218
Needleman and Wunsch (1970) *J. Mol. Biol.* 48: 443-453
Nicholass et al. (1995) *Plant Mol. Biol.* 28: 423-435
Odell et al. (1985) *Nature* 313: 810-812
Odell et al. (1994) *Plant Physiol.* 106: 447-458
Ohl et al. (1990) *Plant Cell* 2: 837-848
Ori et al. (2000) *Development* 127: 5523-5532
Paddison, et al. (2002) *Genes & Dev.* 16: 948-958
Pearson and Lipman (1988) *Proc. Natl. Acad. Sci.* 85: 2444-2448
Peng et al. (1997) *Genes Development* 11:3194-3205
Peng et al. (1999) *Nature* 400: 256-261
Piazza et al. (2002) *Plant Physiol.* 128: 1077-1086
Preiss et al. (1985) *Nature* 313: 27-32
Ratcliffe et al. (2001) *Plant Physiol* 126: 122-132
Riechmann et al. (2000) *Science* 290: 2105-2110
Rieger et al. (1976) *Glossary of Genetics and Cytogenetics: Classical and Molecular*, 4th ed., Springer Verlag, Berlin
Ringli and Keller (1998) *Plant Mol Biol* 37: 977-988
Robson et al. (2001) *Plant J.* 28: 619-631
Rosenberg et al. (1985) *Nature* 313: 703-706
Sadowski et al. (1988) *Nature* 335: 563-564
Sambrook et al. (1989) *Molecular Cloning: A Laboratory Manual*, 2nd Ed., Vol. 1-3, Cold Spring Harbor Laboratory, Cold Spring Harbor, N.Y. ("Sambrook")
Schaffner and Sheen (1991) *Plant Cell* 3: 997-1012
Sharp (1999) *Genes and Development* 13: 139-141
Shi et al. (1998) *Plant Mol. Biol.* 38: 1053-1060
Shimamoto et al. (1989) *Nature* 338: 274-276
Shpaer (1997) *Methods Mol. Biol.* 70: 173-187
Siebertz et al. (1989) *Plant Cell* 1: 961-968
Sjodahl et al. (1995) *Planta* 197: 264-271
Smith and Waterman (1981) *Adv. Appl. Math.* 2: 482-489
Smith et al. (1988) *Nature,* 334: 724-726
Smith et al. (1990) *Plant Mol. Biol.* 14: 369-379
Smith et al. (1992) *Protein Engineering* 5: 35-51
Sonnhammer et al. (1997) *Proteins* 28: 405-420
Stemmer (1994a) *Nature* 370: 389-391
Stemmer (1994b) *Proc. Natl. Acad. Sci.* 91: 10747-10751
Suzuki et al. (2001) *Plant J.* 28: 409-418
Taylor and Scheuring (1994) *Mol. Gen. Genet.* 243: 148-157
Thoma et al. (1994) *Plant Physiol.* 105: 35-45
Thompson et al. (1994) *Nucleic Acids Res.* 22: 4673-4680
Timmons and Fire (1998) *Nature* 395: 854
Tudge (2000) in *The Variety of Life*, Oxford University Press, New York, N.Y., pp. 547-606
Vasil et al. (1990) *Bio/Technol.* 8: 429-434
Vasil et al. (1992) *Bio/Technol.* 10:667-674
Vasil (1993a) *Bio/Technology* 10: 667-674
Vasil et al. (1993b) *Bio/Technol.* 11:1553-1558
Vasil (1994) *Plant Mol. Biol.* 25: 925-937
Wahl and Berger (1987) *Methods Enzymol.* 152: 399-407
Wan and Lemeaux (1994) *Plant Physiol.* 104: 37-48
Wanner and Gruissem (1991) *Plant Cell* 3: 1289-1303
Weeks et al. (1993) *Plant Physiol* 102: 1077-1084
Weigel and Nilsson (1995) *Nature* 377: 482-500
Weissbach and Weissbach (1989) *Methods for Plant Molecular Biology*, Academic Press
Willmott et al. (1998) *Plant Molec. Biol.* 38: 817-825
Winans (1992) *Microbiol. Rev.* 56: 12-31
Wu, ed. (1993) *Methods Enzymol* (vol. 217, Academic Press, San Diego)

Xu et al. (2001) *Proc. Natl. Acad. Sci.*, USA, 98: 15089-15094

Zamore (2001) *Nature Struct. Biol.*, 8: 746-750

Zhang et al. (2000) *J. Biol. Chem.* 275: 33850-33860

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the claims. Modifications that become apparent from the foregoing description and accompanying figures fall within the scope of the following claims.

SEQUENCE LISTING (10667 sequences)

SEQ ID NO: 1 - DNA, 1059 bp, Arabidopsis thaliana
  G1004,family:AP2
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgatc

SEQ ID NO: 2 - protein, 300 aa, Arabidopsis thaliana
  G1004,AP2 domain coordinates 153-221
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 3 - DNA, 913 bp, Arabidopsis thaliana
  G1006,family:AP2
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 4 - protein, 243 aa, Arabidopsis thaliana
  G1006,AP2 domain coordinates 113-177
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 5 - DNA, 923 bp, Arabidopsis thaliana
  G1007,family:AP2
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtacaaaaaaaaaaaaaaaaaaaaaaaaa

SEQ ID NO: 6 - protein, 225 aa, Arabidopsis thaliana
  G1007,AP2 domain coordinates 23-90
MVDSHGSDTECSSKKKKEKTKEKGVYRGARMRSWGKWVSEIREPRKKSRIWLGTFPTAEMAARAHDVAALSIKGSSAILNFPELADFLPRPVSLSQQDIQAAAAEAALMDFKTVPFHLQDDSTPLQTRCDTEKIEKWSSSSSSASSSSSSSSSSSSSMLSGELGDIVELPSLENNVKYDCALYDSLEGLVSMPPWLDATENDFRYGDDSVLLDPCLKESFLWNYE

SEQ ID NO: 7 - DNA, 1354 bp, Arabidopsis thaliana
  G1008,family:AP2
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtaaaaaaaaaaaaaaaaa

SEQ ID NO: 8 - protein, 294 aa, Arabidopsis thaliana
  G1008,AP2 domain coordinates 96-163
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 9 - DNA, 1257 bp, Arabidopsis thaliana
  G1014,family:ABI3/VP-1
cacaaaccacagtctctctttctctctctatctatcttctctttctctctctatctctatcactgaaacccaaagagatccaccatttgttcttttttccttcacacagagaactgttttcttccacacttcctttttactaggcagtgttaaccaattgagagagaaaaatgatggttgatgaaaatgtggaaaccaaggcctctactttagtggcaagtgttgatcatgggtttggatccgggtcgggtcatgatcatcatgggttatcggcgtctgtgcctcttcttggtgttaactggaagaagagaaggatgcctagacagagacgatcttcttcttcctttaaccttctctctttccctcctcctatgcctcctatttcccacgtgccaactcctctccccgcacgtaaaattgacccaagaaagctaagattcctcttccaaaaggaactcaagaacagtgacgtcagctctctccgacgtatgatactcccgaagaaagccgcggaggctcacttgccggcacttgaatgcaaggaagggattcctataagaatggaagatttggacggttttcacgtttggaccttcaagtataggtactggccaaacaacaatagcagaatgtacgtgctagaaaacacaggcgattttgtgaatgctcatggtctgcagctaggtgacttcatcatggtttaccaagatctctactcaaacaattacgttatacaagcaagaaaagcatcggaagaagaagaagtagacgtaatcaatcttgaagaagacgacgtttacacaaacttaacaaggatcgaaaacactgtggttaacgatcttctcctccaagattttaatcatcacaacaacaacaacaacaacaacagcaacagcaacagcaacaaatgttcttactattatccagtcatagatgatgtcaccacaaacacagagtcttttgtctacgacacgacggctcttacctccaacgatactcctctcgattttttgggtggacatacgacgactactaataattattactccaagttcggaacattcgatggtttgggctccgttgagaatatctctctcgatgacttctactagataatcaatcgatgggctcatggtattcttgatggtgatcagctatttaatatccttataatatatataagaattaaatgcaatttgcatatatattatcaagtgttgtaatataacattacagtttaaaaaaaaaaaaaaaaaa

SEQ ID NO: 10 - protein, 312 aa, Arabidopsis thaliana
  G1014,ABI3/VP-1 domain coordinates 90-172
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 11 - DNA, 1301 bp, Arabidopsis thaliana
  G1018,family:ABI3/VP-1
tctaagataaagaaactctcgacgacatcttgagaatcgaacgagaatgatccaaaatctgcaaaaattaccccaagacctccaatcctcggcaatgaagatgcctcctcccttttctgcgtcgaagactcaatacttgttccacgacgagtcatcggaaaactctaaaaagagtttggtctccacaactctttctttgtcgtcttgtgaaaaccctaataagaggaagatgaactctgacgaagttctcaatatttcttgcataccaagagactacaaattaacacaagtagaaagaaagattgcacgaatgaggaatctctcgtatcaagaaaaggcagaggacgaatggtacggtgtctcaacagaactaacactcttcaaggatccgtggatcatcaaaaaggtttttcactttgcttcagtcttggatatggctcccaactcagtctcaaatactcattgcttgttggacacggagtcaccagaaaacgctgaagagagtttggtctccctggatctgtgtttctatgacaaaacatggccacatgatcccaatgttgcttacaataaaccaacgtccgaagaagcaataaacctggcgtggatgaggactatgtcgaagagagcaagaaaagaagaggagaagtactacgtctcgacagaactaactctcctcaccgtcgctgacccatggaccttgaagatggcaatgaccaaaagcagtattggcaacctataccgtcttgttctaaaggcgagctttgtagacatccacattctgagatatctccctttggatgatcaaatgatggtcaaagaagactctggattagcagtcgaggtgtatgatcacgacactgactctgtgcacaatctggctcttaagaaatgggccaaatcttcaagctttgttctcgtcagcggatggcgtaagtgctttgtcgacagaagaggtttgcaggttggcgatgtgattggaatgtattgggatcgttctgaatctaagcttcatttttgtgtgctttctcgttccgaaacaatggattcagctcctcttcctccaagtccataggacctcactagctatggaggctctgcagagagattcttattttctttatgtaatcgtcaaacaagtgattggtgttgtttctgtttttttgttgttgtctcggtgttttggtttcatgtgtttttgttttttaagtataccggtgttgttttttatggtttcatgtggtttttatatgttttaagtgttaataaagaatcctgctctcattataagtaaaaaaaaa

SEQ ID NO: 12 - protein, 342 aa, Arabidopsis thaliana
  G1018,ABI3/VP-1 domain coordinates 222-311
MIQNLQKLPQDLQSSAMKMPPPFSASKTQYLFHDESSENSKKSLVSTTLSLSSCENPNKRKMNSDEVLNISCIPRDYKLTQVERKIARMRNLSYQEKAEDEWYGVSTELTLFKDPWIIKKVFHFASVLDMAPNSVSNTHCLLDTESPENAEESLVSLDLCFYDKTWPHDPNVAYNKPTSEEAINLAWMRTMSKRARKEEEKYYVSTELTLLTVADPWTLKMAMTKSSIGNLYRLVLKASFVDIHILRYLPLDDQMMVKEDSGLAVEVYDHDTDSVHNLALKKWAKSSSFVLVSGWRKCFVDRRGLQVGDVIGMYWDRSESKLHFCVLSRSETMDSAPLPPSP

SEQ ID NO: 13 - DNA, 1218 bp, Arabidopsis thaliana
  G1021,family:PMR
atggaggaagaaagagaaaacactaactctatctacatagtttccgagctacttgaagaaattttccttggattgcctttgaaatcaatcctcaaattcaaaaccgtctcaaaacaatggagatcaatcctggaatcgaacttgttcgtggagaggcgtagaactcttcaaaagaaccacccgaaaatcctggctgcttataactgcgactactgcacgcggccgggtatcctccctaagtctcagttcgaaggggacgaagagatcgtttatcttcataccgacgccacgcaaccctcgatgacttgcgacggtttagtctgcatcaccgaacctggttggttcaacgttttgaacgtctccaccggacaactccgaagatttctacccggtccagatccaggaccgcaagcaaattggctcttgggattcggtagagacaaagttacgggcaagtataaaatagtgaggatgtgttttcatgattgttatgaatttgggattcttgatattgaatctggcgaatggagcaaactgatgtcacctcctcatataatgcgagtgggaagtaaatcggtgtgtgtgaatggatcaatctactggttacaaattagtgtgagttacataatactggccttggatcttcaccaagaaacgttcaatggtgtctaccacctcccggctacgtgggtcacgcaagatacccaattagtgaaccttgaggaccgtctagccatggccatgacgaccaaagttgggcctgaatggatactagagatctggagcatggatatagaagaaaaaggatggagcaagcgttacacatggagcaaggcttactccataagtttagcccatagagttgttgtatcctggccatggcaaaaaaggtggttcacgccggtatcggtttctaagcaagggaatcttgtcttctatgataatcacaagaggctgttcaaatattattcaggtacagatgagattcgttgtctctcctctaacattaatgttatatcttcttacgttgaaaatttggccccacttccgttaaaaccaagccatacgcatcacgatcttgggaattcgaattccaagttcagcacatccagatgccacttgtttccgacgcgaggttcttggatatccaaagtttttagaaggaatgttttgtttacctctctagtagtagttggttatatatacttacctctctaa

SEQ ID NO: 14 - protein, 405 aa, Arabidopsis thaliana
  G1021,PMR domain coordinates NA
MEEERENTNSIYIVSELLEEIFLGLPLKSILKFKTVSKQWRSILESNLFVERRRTLQKNHPKILAAYNCDYCTRPGILPKSQFEGDEEIVYLHTDATQPSMTCDGLVCITEPGWFNVLNVSTGQLRRFLPGPDPGPQANWLLGFGRDKVTGKYKIVRMCFHDCYEFGILDIESGEWSKLMSPPHIMRVGSKSVCVNGSIYWLQISVSYIILALDLHQETFNGVYHLPATWVTQDTQLVNLEDRLAMAMTTKVGPEWILEIWSMDIEEKGWSKRYTWSKAYSISLAHRVVVSWPWQKRWFTPVSVSKQGNLVFYDNHKRLFKYYSGTDEIRCLSSNINVISSYVENLAPLPLKPSHTHHDLGNSNSKFSTSRCHLFPTRGSWISKVFRRNVLFTSLVVVGYIYLPL

SEQ ID NO: 15 - DNA, 1390 bp, Arabidopsis thaliana
  G1022,family:WRKY
aagaatctgagtggttggtctctgatttgatgagatgactgttgagctgatgatgagcagctacagcggcggcggaggaggaggtgatggttttcctgcaatcgccgcggcggcgaaaatggaagataccgctttgagagaagctgcttctgcagggattcacggtgtggaggagtttcttaaactgatcggtcaaagtcaacaaccaacggagaagagtcagacggagataaccgcggtgactgacgtcgccgttaacagcttcaagaaggtcatttctctactcggtagatctagaaccggacacgctagattcagacgagctcccgcgtcaacgcaaacgccgtttaagcaaacgccggtggttgaggaggaggtggaggtggaggagaagaagccagaaacaagctccgtgttaacaaaacagaaaacagagcaatatcacggtggtggatctgcgtttagagtttattgtccaacaccaattcatcgtcgtcctcctctatcacacaataacaacaacaatcagaatcaaacaaagaacggttcgtcttcttcatctcctccgatgctcgcaaacggagcaccgtcaacgataaactttgcgccgtcaccaccagtctcagcgacgaactcattcatgtcttctcatagatgtgacaccgatagtactcacatgtcatcaggattcgagttcactaacccatctcagctctctggttcgagaggtaaacctcctttatcatcagcttcgttgaagagaagatgtaattcatctccctcaagccgttgccattgctccaagaaaaggaaatcaagagtaaaaagagtgattagagttccagcagtaagtagcaaaatggctgatataccatcagatgagttttcatggagaaaatatggtcaaaaaccaatcaaaggctctcctcatcctcggggatattacaagtgcagcagtgtaagaggttgtccggcgcgtaagcatgtggagcgtgcactagatgatgcgatgatgctaatcgtgacgtacgaaggagaccacaaccatgctttggttctcgagacgacgacgatgaatcatgacaaaactctttagtttctcgagtttgaggggaactgtctgtgtgtgaccactatccagattagtcaacgacagagtgggcccgcactgcacttttttattcttttctttttgaaaagcttttgctttatctttctttttgattggaggaaatagagggaggggagataaagacgagagaggaacgttgtggatcttgatggaagttgaatcatgtgaatgtccttttctgtttatttatttctaggataatatatatttagtgcactatttttgtcaaaaaaaaaaaaaaaaaaaaaaaaaaaaaaa

SEQ ID NO: 16 - protein, 353 aa, Arabidopsis thaliana
  G1022,WRKY domain coordinates 281-340
MTVELMMSSYSGGGGGGDGFPAIAAAAKMEDTALREAASAGIHGVEEFLKLIGQSQQPTEKSQTEITAVTDVAVNSFKKVISLLGRSRTGHARFRRAPASTQTPFKQTPVVEEEVEVEEKKPETSSVLTKQKTEQYHGGGSAFRVYCPTPIHRRPPLSHNNNNNQNQTKNGSSSSSPPMLANGAPSTINFAPSPPVSATNSFMSSHRCDTDSTHMSSGFEFTNPSQLSGSRGKPPLSSASLKRRCNSSPSSRCHCSKKRKSRVKRVIRVPAVSSKMADIPSDEFSWRKYGQKPIKGSPHPRGYYKCSSVRGCPARKHVERALDDAMMLIVTYEGDHNHALVLETTTMNHDKTL

SEQ ID NO: 17 - DNA, 874 bp, Arabidopsis thaliana
  G1033,family:HMG
tttttcttttgattctgcttttttccgctaggtttctgagatcttccattcgtctcgaattaagttgctacgatgaaaacagcaaaggggaaagataaagttaagaccacaaaggaagccttgaagccagttgatgacagaaaggtgggaaagaggaaggcaccggctgagaagcctactaaacgagagactcgtaaagagaagaaggctaaaaaggacccaaacaaaccaaaaagagctcctagtgccttctttgtctttctagaagattttagggtcacgttcaagaaagaaaatccaaatgtgaaggccgtctctgctgttgggaaagctggagggcagaaatggaagtcaatgtctcaagctgaaaaagctccatatgaagagaaagctgcaaaaaggaaagctgaatatgagaagcaaatggatgcatacaacaaaaacttggaggaagggagtgatgaatctgaaaagtctagatctgagataaatgatgaagatgaagccagtggggaggaagaactattagagaaggaagcggcaggtgatgatgaagaagaagaagaggaagaagatgtcgatgatgatgacgacgaggaagaagactaaatcagggatagaaatcagattttgtatctcaagcttaactgcagatccttaagcagaagtaagtattttgtaatttgtgtgtggacgagaactatagatctaaaatcgtgtgtttttttgtttttcttttcctaagaaagcgaaacagttgttagcatctctcaggatgtctgtttcagctttttgccgcaacaaacaatgtatcaatgtctgcgttagtgatcatccaaaccaaaacataaactaatgaacatataaaaaaaaa

SEQ ID NO: 18 - protein, 178 aa, Arabidopsis thaliana
  G1033,HMG domain coordinates 49-121
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDVDDDDDEEED

SEQ ID NO: 19 - DNA, 1035 bp, Arabidopsis thaliana
  G1048,family:bZIP
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 20 - protein, 295 aa, Arabidopsis thaliana
  G1048,bZIP domain coordinates 138-190
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 21 - DNA, 549 bp, Arabidopsis thaliana
  G1053,family:bZIP
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 22 - protein, 166 aa, Arabidopsis thaliana
  G1053,bZIP domain coordinates 74-120
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 23 - DNA, 1663 bp, Arabidopsis thaliana
  G1057,family:bZIP
tgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttattgagggttgttggtccagtgtatgtgtgtgtaagttacgaaattagatattgggagaaaaaattccctcgtttaatgttttactttgcctttgctctacttgcagaagcgaatctgaggcaatgtgcttatctgtatcaaaattgttaccctttttattagcttttcctatttat

SEQ ID NO: 24 - protein, 409 aa, Arabidopsis thaliana
  G1057,bZIP domain coordinates 305-365
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 25 - DNA, 2026 bp, Arabidopsis thaliana
  G1062,family:HLH/MYC
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 26 - protein, 494 aa, Arabidopsis thaliana
  G1062,HLH/MYC domain coordinates 300-357
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 27 - DNA, 869 bp, Arabidopsis thaliana
  G1065,family:DBP
cggacgcgtgggtttggttttcttttttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaaaatatgtttcattgttttctaaaaaaaaaaaaaaaaaaaaaaa

SEQ ID NO: 28 - protein, 212 aa, Arabidopsis thaliana
  G1065,DBP domain coordinates 101-210
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 29 - DNA, 1473 bp, Arabidopsis thaliana
  G1067,family:AT-hook
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 30 - protein, 311 aa, Arabidopsis thaliana
  G1067,AT-hook domain coordinates 86-94,95-246
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 31 - DNA, 1464 bp, Arabidopsis thaliana
  G1072,family:AT-hook
gacactatgtttttttttcttcttcttgtttggatcatataaatctgattttttcccggaaaataccgttgagaacttctccggcgtgagctgaccaggagaaatctgttcttgtgtttagttcaattctcggctgaggaacgttgactgttgactgatagagcaacttcagtgtgttgagactaaacataaagcttcagttaaggataggatttgagaatggaaacaagcgacagaattagccctggtggtggtataggagcagaagttccatcagcgtatcatatggctccgagaccttcagatagccctgctaaccagtttatggggttgtctctccctcccatggaagccccaatgccttcttcaggggaagcctcagggaagaagaggagaggcagacctcgtaaatatgaagctaatggtgctcctttgccttcttcatcagttcctcttgtgaagaaacgagtaagaggcaagctcaatggttttgatatgaagaagatgcataagaccattgggttccattcttctggtgaaaggtttggtgttggtggtggtgttggtggtggtgttggatcaaatttcacgccgcatgtaatcacagtgaacactggtgaggatattactatgagaatcatctccttttcacaacaaggaccacgagctatttgtatcttatcagcaaatggagtgatatcaaacgttactcttcgccaacccgattcttgcggtggtactctcacctacgagggtcggtttgagatactgtctctgtctggttcattcatggaaacagagaatcaaggttcaaaaggtcggtctggtggcatgagtgtatctttggccggtcctgatggtcgtgttgtcggtggcggtgtcgctggcctgctcattgccgccactcctattcaggttgttgttggcagttttataacgagtgatcaacaagatcatcagaaaccgaggaagcaaagagtcgagcatgcccctgcagcagtcatgtcagtgcctcctcctccttctcctcctcctccggcggcttctgttttctcaccgacaaacccggacagagagcagccgccatcttcattcggtatctccagctggaccaacggacaggacatgccgagaaactcagccactgacatcaacatatctttaccagtcgactgagtttgagtttccagatggaagattaggtttcagattaactctctactgtctgtacaatggttaggaggattgttgaagctgaatgttactgtacgcttttctttattttagaacacaacttgagcttcttctacttttagggtaactttctctgatgacttgcctcttgttacttactatattgctagtactgaggtttaatccttttaatggcggattaatctgtgttgttcccttttagttgttttctttattgatattttacactatttagtatcccccaaaaaa

SEQ ID NO: 32 - protein, 318 aa, Arabidopsis thaliana
  G1072,AT-hook domain coordinates 56-64,123-238
METSDRISPGGGIGAEVPSAYHMAPRPSDSPANQFMGLSLPPMEAPMPSSGEASGKKRRGRPRKYEANGAPLPSSSVPLVKKRVRGKLNGFDMKKMHKTIGFHSSGERFGVGGGVGGGVGSNFTPHVITVNTGEDITMRIISFSQQGPRAICILSANGVISNVTLRQPDSCGGTLTYEGRFEILSLSGSFMETENQGSKGRSGGMSVSLAGPDGRVVGGGVAGLLIAATPIQVVVGSFITSDQQDHQKPRKQRVEHAPAAVMSVPPPPSPPPPAASVFSPTNPDREQPPSSFGISSWTNGQDMPRNSATDINISLPVD

SEQ ID NO: 33 - DNA, 1342 bp, Arabidopsis thaliana
  G1076,family:AT-hook
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 34 - protein, 292 aa, Arabidopsis thaliana
  G1076,AT-hook domain coordinates 82-90,91-233
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 35 - DNA, 2597 bp, Arabidopsis thaliana
  G1078,family:BZIPT2
agtatagtgtagtgggaaagtctggaaacagctgtatctaactttttcccttttctctatgattctgttgtgaataatgcagagccgccgtgagctcaggcgccaccgtaacgaagaacaaacctgaaggagaaaaataagccatgggatgtgcggcgtccaagctcgataacgaagatgctgtacggcgttgtaaggatcgccgccgtctgatgaaagaagctgtctacgctcgtcatcatctcgccgccgctcacgccgattactgccgatcgcttcgtatcactggatctgctctttcctcattcgcctccggtgagcctctctctgtatctgatcaaactccggctgttttcctccatactccccctcctccgctttctgaacaatctccggctaaatttgtccctccacgtttttcgccgtcgcctgctccttcttctgtttatcctccttcgacgtctccttccgtcgccagttctaagcagccttcagtcatgtccacctcttccaatcgacgccggaaacagcaaccaaaacctagactgcctcatattctctcggagtcaagtcattcttcttctccgagaagtgagagatccaatttcatgcccaatttgtatcccagtgcttatcagaactctacttactccgctactccttctcatgcctcctccgtctggaactgggagaatttctaccctccttctcctcccgattccgaattcttcaacaggaaggctcaagagaagaaacataactccgataatcgattcaacgacgaggatacggaaacagtgaggtcagagtatgatttcttcgacacgaggaagcaaaagcagaagcagttcgaatcaatgagaaatcaggtggaggaagagacggagacggagagagaggaagtacagtgtagtgaatgggaggatcacgatcattacagcaccacgagctcctcggacgcagcggaggaagaggaagaagatgatgatagagaatcaatttccgaggtcgggacacgctccgagtttggatctacggtgagaagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtg

SEQ ID NO: 36 - protein, 796 aa, Arabidopsis thaliana
  G1078,BZIPT2 domain coordinates 1-53,440-550
MGCAASKLDNEDAVRRCKDRRRLMKEAVYARHHLAAAHADYCRSLRITGSALSSFASGEPLSVSDQTPAVFLHTPPPPLSEQSPAKFVPPRFSPSPAPSSVYPPSTSPSVASSKQPSVMSTSSNRRRKQQPKPRLPHILSESSHSSSPRSERSNFMPNLYPSAYQNSTYSATPSHASSVWNWENFYPPSPPDSEFFNRKAQEKKHNSDNRFNDEDTETVRSEYDFFDTRKQKQKQFESMRNQVEEETETEREEVQCSEWEDHDHYSTTSSSDAAEEEEEDDDRESISEVGTRSEFGSTVRSNSMRRHHQQPSPMPQVYGGAEQSKYDKADDATISSGSYRGGGDIADMKMVVRHRDLKEIIDAIKENFDKAAASGEQVSQMLELGRAELDRSFSQLKKTVIHSSSLLSNLSSTWTSKPPLAVKYRIDTTALDQPNSSKSLCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQNSIVEQVRGLINRSGKGESTSELHRQATRDLESAVSSWHSSFSSLIKFQRDFIHSVHAWFKLTLLPVCQEDAANHHKEPLDAYAFCDEWKLALDRIPDTVASEAIKSFINVVHVISAKQADEHKIKKRTESASKELEKKASSVRNLERKYYQSYSMVGVGLPESGPDNRHMLDARDPLSDKKSELAVCQRRVEEEMVKYSKAIEVTRAMTLNNLQTGLPGVFQSLTSFSALFMESLQTVCTRSYSIK

SEQ ID NO: 37 - DNA, 2564 bp, Arabidopsis thaliana
  G1080,family:BZIPT2
tgattcgctgctgactcacacacgacacagaccacctctctccttcttcttcgtctcctgtagaagaagacgttttgttttcttttgggtttgatcctctcgcgtaactccaaagctctcaaaggacatctctttagcttggacaatgggtgcatcaacatccagaatagatgaagataaagccttacagttatgtcgagaaagaaaaaaattcgtccaacaagcactcgatggaagatgtttgttagctgctgctcacgtttcatacgttcagtctcttaagagtaccggaactgccctcaggaaattttctgagactgaagttccagttgaatcttccttgtacacgtccactagtgcaacaccagaacaacctcttgctttaatcgagaaatctgtttctcatttgtcatactctcctccacctgcttcacattcccaccatgacacgtattctcctcctccgtcgcctcctagtaccagtccgttccaggtcaatcatatgaaattcaaagggttttcttcaaaaaaagtggaagagaaaccaccagtatctattattgccactgttacctcatccagtatcccaccaagcaggtctatagaaaagatggaatcaaccccatttgaggaatcttcttccatgccacctgaagcaccttgggattattttggtctttctcatccaattgacaaccagttttcttcttctcatgttgggaatggtcatgtgtcgagatctgttaaggaggaagatggaactccagaggaggaagatgatggtgaggacttttcttttcaagaaagggaagagtccagagattcggatgatgatgagtttgatgaacccacaagtgatactcttgttagaagctttgaaaacttcaatagagtgcgccgtgatcacagtactttgcctcaaagagagggagtggaaagcgactcctcagacgctgagaaaagtaaaactcctgagttatcaccaccagtgacgcctttagtagctactccagtgaacaaaacaccaaacaagggagatcacaccgagaacaagcttcctcccagggacttcttgtcaagtatgaaagagatagagttgctctttgttaaagcttcagagactggaaaagaggttcctaggatgcttgaagccaataaactacatttccgtccaatagttccatcaaaagaaagtggctccggtgcatcatcactgttcaaaacctgtctctcttgtggggaagatccaaaagatgtaccggaagagcctgctcagatctctgtgaaatacttgacctggcataggactgaatcttcacgatcctcatcttctcggaatcctctcgaaggaatcaattctgatgatgtggaagagctcaatagtaatctctttgaaaacatttgcatgattgctggaagccatgcctcaacgctagacagattgtatgcatgggagcggaagctctatgatgaagttaaggggagtcagactgtgcggagagagtatgacgaaaagtgcagaattttgagagaacttgaatcagaaggtaaaggttcacaaagaatagacaagacacgtgcagttgtgaaagaccttcactccagaatcagagtggcgattcataggatcgactcaatatcaagacggattgaagaactccgtgacaatgagctccagcctcaacttgaagaactcattgaagggttgagtcgtatgtgggaagtaatgttggaatgccacaaggttcagtttcagttaatcaaagcgtgttacagaggcggaaacattaaactcaacatgcaatcagagttgcacagacaagtaacatctcaccttgaagatgagctctgcgcattggcctcaagctttacaaaatggatcacaggccagaaatcgtatattcaagcgataaacgagtggctggtgaaatgtgtcgccttaccacaacgatccaaacgaaaaaggcgtgcaccacaaccgtctttgagaaactatgggccccccatttatgcaacctgtggaatctggctagaaaagctcgaagtcttacctaccaaagaggtttcaggctccattaaagcacttgcttctgatgttgccaggttcttgccacgtcaggagaagaatcgcaccaagaaacatcgatctggtgagaacaaaaacgatttgacagctcacatgttgcaagatgagacattggaggattgtggtccgggatttgatcggtttaggacaagcttggaaggatttgttggacaactcaaccagtttgcagaatcatcagtgaaaatgtatgaggaacttaaagaaggaatccacggagctaaaaacaactacgagcagttgaagaaggcgtactcttcacaaggaaaatgaatttttttggtttcttagaaaaatggagttttgtcaggttagaattttggagggaaaattgggtttaggcatttgtaaatgcaaaagggattacataaaaagattgcttcaagcatgaatttggcagataattgtgatagttaacttgtgcctttgtggtgggaataacaaaataaataattaaata

SEQ ID NO: 38 - protein, 743 aa, Arabidopsis thaliana
  G1080,BZIPT2 domain coordinates 1-50
MGASTSRIDEDKALQLCRERKKFVQQALDGRCLLAAAHVSYVQSLKSTGTALRKFSETEVPVESSLYTSTSATPEQPLALIEKSVSHLSYSPPPASHSHHDTYSPPPSPPSTSPFQVNHMKFKGFSSKKVEEKPPVSIIATVTSSSIPPSRSIEKMESTPFEESSSMPPEAPWDYFGLSHPIDNQFSSSHVGNGHVSRSVKEEDGTPEEEDDGEDFSFQEREESRDSDDDEFDEPTSDTLVRSFENFNRVRRDHSTLPQREGVESDSSDAEKSKTPELSPPVTPLVATPVNKTPNKGDHTENKLPPRDFLSSMKEIELLFVKASETGKEVPRMLEANKLHFRPIVPSKESGSGASSLFKTCLSCGEDPKDVPEEPAQISVKYLTWHRTESSRSSSSRNPLEGINSDDVEELNSNLFENICMIAGSHASTLDRLYAWERKLYDEVKGSQTVRREYDEKCRILRELESEGKGSQRIDKTRAVVKDLHSRIRVAIHRIDSISRRIEELRDNELQPQLEELIEGLSRMWEVMLECHKVQFQLIKACYRGGNIKLNMQSELHRQVTSHLEDELCALASSFTKWITGQKSYIQAINEWLVKCVALPQRSKRKRRAPQPSLRNYGPPIYATCGIWLEKLEVLPTKEVSGSIKALASDVARFLPRQEKNRTKKHRSGENKNDLTAHMLQDETLEDCGPGFDRFRTSLEGFVGQLNQFAESSVKMYEELKEGIHGAKNNYEQLKKAYSSQGK

SEQ ID NO: 39 - DNA, 2535 bp, Arabidopsis thaliana
  G1084,family:BZIPT2
atgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactatctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaaggactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctag

SEQ ID NO: 40 - protein, 844 aa, Arabidopsis thaliana
  G1084,BZIPT2 domain coordinates 1-53,490-619
MGCSHSKLDDEEAVQICKDRKRFIKQAIEHRTKFASGHIAYIHSLRKVSDALHDFILQGDNNNEFVPTLCQDSFVTPVKRMPQRRRRSSRSNSGEFISISPSSIPPKMIQGRPRSNVKANYLMANRSRPVRVEQRSPETFRVETFSPPSSSNQYGESDGFFGMNMNMNTSASTSSSFWNPLSSPEQRLSSHNIPPPSPQNSQWDFFWNPFSSLDYYGYNSYDRGSVDSRSGIDDEIRGLRRVREEEGIPDLEEDDEPHKPEPVVNVRFQNHNPNPKATEENRGKVDKSCCNEEVKVEDVDEDEDEDGDEDDDEFTDSGCETENEGDEKCVAPPTQEQRKAEVCRGGEATGNVVGVGKVQEMKNVVGVRDDAKTTGFTVYVNRRPTSMAEVIKDLEDQFTTICDAAKEVSGLLEAGRAQYTSSFNDHSGEFMNNVAIFLSRKMLNPVALFRSGSSRSSSSRFLITSSGGSRESGSESRSDVSDESCMISGSHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQKRTLDEAKLLLAGTPVSKRHKKRQPPIMPEAINSQRLAQSALNLEAQLRNWRTCFEFWITSQRSYMKALSGWLLRCFRCDPDPEKVRLSSCLHPIYRVCIQWSRLLNSLNEKPVLDKLEFFASGMGSIYARQVREDPNWSGSGSRRYSGSESMELVVADKGEEDVVMTAEKLAEVAVKVLCHGMSVAVSSLAEFSINSADEHSKLVSQPADDASEQQPPDVNFNS

SEQ ID NO: 41 - DNA, 2663 bp, Arabidopsis thaliana
  G1089,family:BZIPT2
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 42 - protein, 798 aa, Arabidopsis thaliana
  G1089,BZIPT2 domain coordinates 425-500
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 43 - DNA, 838 bp, Arabidopsis thaliana
  G1090,family:AP2
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 44 - protein, 184 aa, Arabidopsis thaliana
  G1090,AP2 domain coordinates 17-84
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 45 - DNA, 1279 bp, Arabidopsis thaliana
  G1091,family:WRKY
ggtttttttttttggttctctgatctgaaacttgggtagaagaaaaacatggaggaagttgaagctgctaacagatcagctatagaaagctgtcatggagtgttaaatctcttgtcacaacgaaccagtgatcccaaatccttaacggttgaaacaggagaagtagtttccaagttcaaaagagtagcttctctgttaactagagggttaggccatggaaagtttaggagtaccaacaagtttaggtcatcttttcctcaacacatcttcttagagagtcctatttgctgcggtaatgatctaagtggtgattacactcaagttcttgcaccagagccacttcagatggttccagcttctgctgtttataatgaaatggagccaaaacaccaattgggtcatccttcattaatgcttagtcacaaaatgtgtgttgacaagtcgtttctggagttaaagccacctccttttcgtgctccttatcagttaatccacaaccaccagcagatagcttactccaggagtaatagcggtgtaaaccttaagtttgatggatctggtagtagttgctatactccgagtgtatcaaacggatcaagatcatttgtgtcatctcttagcatggatgctagtgtaacagactacgataggaactcgttccatttgaccggattgtcccgtgggtctgaccaacagcatacccggaagatgtgctctggtagtttgaaatgcggaagtcgaagcaaatgtcactgttccaagaaaaggaaactgagggtaaaacgatcaatcaaggtgcctgcaatcagtaacaagattgcagacattcctccagatgagtattcttggaggaagtatggacagaaaccgataaagggttcaccgcatccacggggatactataaatgcagcagtgtgagaggttgtccagcaaggaagcatgtggagcgatgtattgatgaaacttcaatgttaattgtaacttacgaaggcgagcataaccattcaagaatattgtcttcacaatcagctcacacttgatgatacagagtcaatatgtatgtccttttggcgtctactcttggatttgaagaaagaatgaatttgattcaagaaaccggtctttgtagctctgatttgcaattgtatatttccactctgacagaagttataagagcacttgtgaactcggattatgtggcagaggcagtaccaagaaacatcaacaatttggtttcaactgagctttttcttcaaaaaaaaaaaaaaaaaaaaaaaa

SEQ ID NO: 46 - protein, 330 aa, Arabidopsis thaliana
  G1091,WRKY domain coordinates 262-319
MEEVEAANRSAIESCHGVLNLLSQRTSDPKSLTVETGEVVSKFKRVASLLTRGLGHGKFRSTNKFRSSFPQHIFLESPICCGNDLSGDYTQVLAPEPLQMVPASAVYNEMEPKHQLGHPSLMLSHKMCVDKSFLELKPPPFRAPYQLIHNHQQIAYSRSNSGVNLKFDGSGSSCYTPSVSNGSRSFVSSLSMDASVTDYDRNSFHLTGLSRGSDQQHTRKMCSGSLKCGSRSKCHCSKKRKLRVKRSIKVPAISNKIADIPPDEYSWRKYGQKPIKGSPHPRGYYKCSSVRGCPARKHVERCIDETSMLIVTYEGEHNHSRILSSQSAHT

SEQ ID NO: 47 - DNA, 1114 bp, Arabidopsis thaliana
  G1098,family:RING/C3H2C3
agagtgagaagctcaggatgtcaagcagtcgaaatacccactggtgtcacagatgtcagcgtgctgtccgccttcacggccaagagcctgtatgcttttattgcggaggtggatttgttgaagaacttgatatggctcaagccagcccctttgatatgtttagatcccacaggggtgttgtagaacgtgatcagacttttgatctcatggatgctttctctgtgtttatgaggaaccgcttagctgaaaggagccacgacagagaaatcagaggaagaaccatcagttcaggtcctgaaaactttcctggtctggcccctttgttgatctttggtggtcaagtcccttatagactaactggcgacaatgcagtcgaagccctcttcaatggcggctcccctggcattggcatcacacgtggtaacaccggcgactacttcttcggtcccggccttgaagaattgttcgagcagctttcagctggcactactcgccgaggcccaccacccgcaccgagatcagcaatagacgcattgccaactatcaagatcgcgcagaggcatcttaggtcatcggactcgaattgtcccgtgtgcaaagacgaattcgaactgggatcagaagcgaaacagatgccgtgtaaccacatctatcattctgactgcattgtcccgtggctggttcagcacaactcttgcccggtctgtcgccaagagctaccatcagctagcggaccttcaagcagtcaaaacagaaccacccctaccagaaactacagaagcagtagtagtagtagtagtagtaacagtcgtgagaacgggaatgaaagaaggaatcctttctcttccttctggccattccgttcgtcaggttcaagctcaagctccactcaaaaccgtggaggcacaagaaactcggatacaagcgatgagaaccataactaccatcaacagcaacatcaacaatcatatatgggttacagtggctggccttttgattactaaaagtctaaaagtgagctaaaacaaatctttggtctcactttggtctctttacttaaatatgcttgtgattctgcatatgccttgtgcttcactctctatctctctcactc

SEQ ID NO: 48 - protein, 328 aa, Arabidopsis thaliana
  G1098,RING/C3H2C3 domain coordinates 10-29,190-230,255-262,286-290
MSSSRNTHWCHRCQRAVRLHGQEPVCFYCGGGFVEELDMAQASPFDMFRSHRGVVERDQTFDLMDAFSVFMRNRLAERSHDREIRGRTISSGPENFPGLAPLLIFGGQVPYRLTGDNAVEALFNGGSPGIGITRGNTGDYFFGPGLEELFEQLSAGTTRRGPPPAPRSAIDALPTIKIAQRHLRSSDSNCPVCKDEFELGSEAKQMPCNHIYHSDCIVPWLVQHNSCPVCRQELPSASGPSSSQNRTTPTRNYRSSSSSSSSNSRENGNERRNPFSSFWPFRSSGSSSSSTQNRGGTRNSDTSDENHNYHQQQHQQSYMGYSGWPFDY

SEQ ID NO: 49 - DNA, 499 bp, Arabidopsis thaliana
  G1113,family:RING/C3H2C3
ctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 50 - protein, 157 aa, Arabidopsis thaliana
  G1113,RING/C3H2C3 domain coordinates 85-128
MGLPTDFKELQIPGYVLKTLYVIGFFRDMVDALCPYIGLPSFLDHNETSRSDPTRLALSTSATLANELIPVVRFSDLLTDPEDCCTVCLSDFVSDDKIRQLPKCGHVFHHRCLDRWIVDCNKITCPICRNRFLPEEKSTPFDWGTSDWFRDEVESTN

SEQ ID NO: 51 - DNA, 1407 bp, Arabidopsis thaliana
  G1127,family:AT-hook
gacagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatggattccagagacatcccaccgtcacataaccagcttcaaccaccaccgggaatgttaatgtctcattaccgtaaccctaacgccgccgcttcaccattaatggttcccacttccacatctcaaccgattcaacaccctcgtcttccttttggcaatcaacaacaatctcaaacgtttcatcagcagcaacaacaacaaatggatcagaagactcttgaatctcttggatttggtgatggatcaccttcttctcaaccgatgcgattcgggatcgatgatcagaatcagcaactgcaagtgaagaagaagcgaggaaggccgagaaagtatactcctgatggtagcattgctttaggtttagctcctacgtctcctcttctctctgcagcttctaattcttacggtgagggtggtgttggagatagtggtggaaatggaaactctgttgatccacctgttaaacgtaacagaggaaggcctcctggttctagtaagaaacagcttgatgctttaggaggaacttcaggagttgggtttacacctcatgtcattgaagtgaacacaggagaggacatagcgtcaaaggtgatggctttttcggatcaagggtcaagaacaatttgtattctctctgcaagtggtgcagtttctagagtgatgcttcgtcaagcttctcattctagtggaatcgttacttatgagggacgatttgagatcattactctctcaggctcagtcttgaattatgaggtaaatggttccaccaacagaagtggtaacttgagtgtggctttggctggacctgatggcggcatcgtaggtggcagtgtagttggtaatctagtagctgcaacacaagtccaggtgatagtgggaagctttgttgcagaagcaaagaaaccgaaacaaagtagtgttaacattgctcgggggcagaatcctgaaccggcttcagcgccggctaacatgttgaactttggatcagtctctcaaggaccatcgagcgagtcatcagaagagaatgagagcggttctcctgcaatgcaccgtgacaataataatgggatatatggagctcaacaacaacaacaacaacaacctcttcatcctcatcagatgcaaatgtaccaacatctttggtctaatcatggtcaataaaatgaagcggaaattaatttgtttccgttttggttacggttatggtttgatttctt

SEQ ID NO: 52 - protein, 386 aa, Arabidopsis thaliana
  G1127,AT-hook domain coordinates 102-110,155-162,180-295
MDSRDIPPSHNQLQPPPGMLMSHYRNPNAAASPLMVPTSTSQPIQHPRLPFGNQQQSQTFHQQQQQQMDQKTLESLGFGDGSPSSQPMRFGIDDQNQQLQVKKKRGRPRKYTPDGSIALGLAPTSPLLSAASNSYGEGGVGDSGGNGNSVDPPVKRNRGRPPGSSKKQLDALGGTSGVGFTPHVIEVNTGEDIASKVMAFSDQGSRTICILSASGAVSRVMLRQASHSSGIVTYEGRFEIITLSGSVLNYEVNGSTNRSGNLSVALAGPDGGIVGGSVVGNLVAATQVQVIVGSFVAEAKKPKQSSVNIARGQNPEPASAPANMLNFGSVSQGPSSESSEENESGSPAMHRDNNNGIYGAQQQQQQQPLHPHQMQMYQHLWSNHGQ

SEQ ID NO: 53 - DNA, 1150 bp, Arabidopsis thaliana
  G1131,family:HLH/MYC
tcgactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 54 - protein, 233 aa, Arabidopsis thaliana
  G1131,HLH/MYC domain coordinates 160-217
MSMDCLSYFFNYDPPVQLQDCFIPEMDMIIPETDSFFFQSQPQLEFHQPLFQEEAPSQTHFDPFCDQFLSPQEIFLPNPKNEIFNETHDLDFFLPTPKRQRLVNSSYNCNTQNHFQSRNPNFFDPFGDTDFVPESCTFQEFRVPDFSLAFKVGRGDQDDSKKPTLSSQSIAARGRRRRIAEKTHELGKLIPGGNKLNTAEMFQAAAKYVKFLQSQVGILQLMQTTKKVITNPK

SEQ ID NO: 55 - DNA, 1322 bp, Arabidopsis thaliana
  G1133,family:HLH/MYC
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 56 - protein, 326 aa, Arabidopsis thaliana
  G1133,HLH/MYC domain coordinates 260-317
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 57 - DNA, 1064 bp, Arabidopsis thaliana
  G1134,family:HLH/MYC
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 58 - protein, 262 aa, Arabidopsis thaliana
  G1134,HLH/MYC domain coordinates 187-245
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 59 - DNA, 2215 bp, Arabidopsis thaliana
  G1136,family:HLH/MYC
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 60 - protein, 592 aa, Arabidopsis thaliana
  G1136,HLH/MYC domain coordinates 408-465
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 61 - DNA, 1311 bp, Arabidopsis thaliana
  G1137,family:HLH/MYC
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 62 - protein, 348 aa, Arabidopsis thaliana
  G1137,HLH/MYC domain coordinates 257-314
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 63 - DNA, 956 bp, Arabidopsis thaliana
  G1140,family:MADS
atccaagatcctccaactcacagaaaggcagattcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattgggtctttataactatttttctccccaaaaaaaaaaaaaaaaaaaaaaaaaaaaa

SEQ ID NO: 64 - protein, 220 aa, Arabidopsis thaliana
  G1140,MADS domain coordinates 2-57
MAREKIRIKKIDNITARQVTFSKRRRGIFKKADELSVLCDADVALIIFSATGKLFEFSSSRMRDILGRYSLHASNINKLMDPPSTHLRLENCNLSRLSKEVEDKTKQLRKLRGEDLDGLNLEELQRLEKLLESGLSRVSEKKGECVMSQIFSLEKRGSELVDENKRLRDKLETLERAKLTTLKEALETESVTTNVSSYDSGTPLEDDSDTSLKLGLPSWE

SEQ ID NO: 65 - DNA, 1413 bp, Arabidopsis thaliana
  G1141,family:AP2
gtctttacaaaaagaaaagaaaaaagagacgctagaaagaacgcgaaagcttgcgaagaagatttgcttttgatcgacttaacacgaacaacaaacaacatctgcgtgataaagaagagatttttgcctaaataaagaagagattcgactctaatcctggagttatcattcacgatagattcttagattgcgactataaagaagaagatggctgtatatgaacaaaccggaaccgagcagccgaagaaaaggaaatctagggctcgagcaggtggtttaacggtggctgataggctaaagaagtggaaagagtacaacgagattgttgaagcttcggctgttaaagaaggagagaaaccgaaacgcaaagttcctgcgaaagggtcgaagaaaggttgtatgaagggtaaaggaggaccagataattctcactgtagttttagaggagttagacaaaggatttggggtaaatgggttgcagagattcgagaaccgaaaataggaactagactttggcttggtacttttcctaccgcggaaaaagctgcttccgcttatgatgaagcggctaccgctatgtacggttcattggctcgtcttaacttccctcagtctgttgggtctgagtttactagtacgtctagtcaatctgaggtgtgtacggttgaaaataaggcggttgtttgtggtgatgtttgtgtgaagcatgaagatactgattgtgaatctaatccatttagtcagattttagatgttagagaagagtcttgtggaaccaggccggacagttgcacggttggacatcaagatatgaattcttcgctgaattacgatttgctgttagagtttgagcagcagtattggggccaagttttgcaggagaaagagaaaccgaagcaggaagaagaggagatacagcaacagcaacaggaacagcaacagcaacagctgcaaccggatttgcttactgttgcagattacggttggccttggtctaatgatattgtaaatgatcagacttcttgggatcctaatgagtgctttgatattaatgaactccttggagatttgaatgaacctggtccccatcagagccaagaccaaaaccacgtaaattctggtagttatgatttgcatccgcttcatctcgagccacacgatggtcacgagttcaatggtttgagttctctggatatttgagagttctgaggcaatggtcctacaagactacaacataatctttggattgatcataggagaaacaagaaataggtgttaatgatctgattcacaatgaaaaaatatttaataactctatagtttttgttctttccttggatcatgaactgttgcttctcatctattgagttaatatagcgaatagcagagtttctctcataaaaaaaaaaaaaa

SEQ ID NO: 66 - protein, 330 aa, Arabidopsis thaliana
  G1141,AP2 domain coordinates 75-142
MAVYEQTGTEQPKKRKSRARAGGLTVADRLKKWKEYNEIVEASAVKEGEKPKRKVPAKGSKKGCMKGKGGPDNSHCSFRGVRQRIWGKWVAEIREPKIGTRLWLGTFPTAEKAASAYDEAATAMYGSLARLNFPQSVGSEFTSTSSQSEVCTVENKAVVCGDVCVKHEDTDCESNPFSQILDVREESCGTRPDSCTVGHQDMNSSLNYDLLLEFEQQYWGQVLQEKEKPKQEEEEIQQQQQEQQQQQLQPDLLTVADYGWPWSNDIVNDQTSWDPNECFDINELLGDLNEPGPHQSQDQNHVNSGSYDLHPLHLEPHDGHEFNGLSSLDI

SEQ ID NO: 67 - DNA, 3323 bp, Arabidopsis thaliana
  G1146,family:PAZ
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 68 - protein, 988 aa, Arabidopsis thaliana
  G1146,PAZ domain coordinates 886-896
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 69 - DNA, 2637 bp, Arabidopsis thaliana
  G1148,family:PAZ
atggagacatcttcatctctgccactgtcacccataagtatagaaccagaacagcccagccatcgagattatgacatcacaactagacgtggggttggaaccacaggcaacccaatagaattgtgcaccaatcactttaatgtttctgtgagacagccggatgtagtattttaccagtacactgttagtatcaccacagaaaacggtgatgctgttgatgggacaggaataagcagaaagcttatggaccaactattcaagacttactcttctgatcttgatggtaaaaggttggcatatgatggagagaagactttatatactgttggtcctctaccacagaacgaatttgactttctagtcatcgtggaagggtcattttcaaaacgtgattgtggtgtctctgatggtggtagttcttccggtacttgcaagcgatcaaaacgttctttcttgccaagaagttacaaggttcagatacattatgctgcagaaataccgttgaagactgttcttggcactcagagaggagcttatacaccagataagagtgctcaggatgcacttagagtgcttgacattgtactgaggcagcaagcagctgaaaggggatgccttttggtcagacaggcatttttccatagcgatgggcaccccatgaaagttggaggaggtgttataggtattcgaggtttacattcgagctttcgtccaactcatggaggactctcgcttaacattgatgtgtcaacaacaatgatcttagaacctggtccagttattgaattcctgaaagccaatcagagtgttgagacaccacggcaaatcgactggattaaggctgcgaaaatgcttaaacatatgagggttaaggcaacacaccgtaacatggaatttaaaattataggtctaagttcgaaaccgtgcaatcagcaactgttttcaatgaagattaaagatggtgaacgtgaggtacctattagagagattactgtgtatgactatttcaagcaaacctacacagagcctatttcttctgcgtactttccatgccttgatgttggcaagccagatcggcccaactatcttccactggagttttgtaatcttgtatctctgcaacgttatacaaaaccattgtcagggaggcaaagagttttacttgttgaaagttcaagacaaaaacctctagagagaattaaaacactcaatgatgcaatgcatacctactgctatgacaaggacccatttttggctggatgtggcatctccattgaaaaagaaatgactcaagttgaaggccgtgttctcaagcccccaatgctgaagtttggcaagaatgaagattttcaaccttgcaacggacggtggaactttaacaacaagatgcttctagaaccaagagctattaaaagctgggctatcgtcaacttttcttttccatgcgacagtagtcacatttcccgtgagcttataagctgtggcatgaggaaaggcattgaaattgatcgaccttttgcactagttgaagaggatccacagtacaaaaaagcaggtcctgttgaaagggtagaaaaaatgattgcaacgatgaagttaaaatttccagatcctcctcattttatcctctgtattctgccagaacggaaaacttctgatatctatggtccctggaagaagatatgcctcactgaagaagggatccacacacaatgcatctgcccaatcaagatcagtgaccaatatctcaccaatgtacttctgaagataaattcgaagcttggaggcatcaattctctgttgggaatagagtactcttacaacattccattgataaacaaaattcccaccttgattttgggtatggatgtatctcatgggcctccaggtcgggcagatgttccttcagtagcagcggttgttggttcaaaatgctggcccttaatctcaaggtatagggcagctgtaagaactcagtcaccacgtctggagatgattgattcgctcttccaacctatcgagaacactgagaaaggagataacggtatcatgaacgaattatttgtagagttctatcggacaagcagggcacggaaacctaagcagattatcattttcagggatggtgtgagtgaatcacagttcgagcaagtcttgaagatcgaagtggaccaaattataaaggcgtatcaacgtcttggtgaatctgatgtgccaaaattcactgtcattgtggctcagaagaaccaccacaccaagttgtttcaagctaagggtcctgaaaatgttcctgcaggaactgtcgtggacaccaagatcgtacacccgacaaactacgatttttacatgtgtgctcatgcaggaaaaataggaacttcaagaccggctcattaccatgtattacttgatgagattggtttctcccccgatgacttgcagaatctcatccattctctctcctatgtcaaccaacgtagcacaactgcaacttcgatcgtggctccagtacgatacgctcatcttgcagcagctcaagttgcgcaattcacaaagtttgaaggtatatcggaggacgggaaagttccagagcttccacgtctgcacgagaatgtcgaaggcaacatgttcttctgctga

SEQ ID NO: 70 - protein, 878 aa, Arabidopsis thaliana
  G1148,PAZ domain coordinates 770-807
METSSSLPLSPISIEPEQPSHRDYDITTRRGVGTTGNPIELCTNHFNVSVRQPDVVFYQYTVSITTENGDAVDGTGISRKLMDQLFKTYSSDLDGKRLAYDGEKTLYTVGPLPQNEFDFLVIVEGSFSKRDCGVSDGGSSSGTCKRSKRSFLPRSYKVQIHYAAEIPLKTVLGTQRGAYTPDKSAQDALRVLDIVLRQQAAERGCLLVRQAFFHSDGHPMKVGGGVIGIRGLHSSFRPTHGGLSLNIDVSTTMILEPGPVIEFLKANQSVETPRQIDWIKAAKMLKHMRVKATHRNMEFKIIGLSSKPCNQQLFSMKIKDGEREVPIREITVYDYFKQTYTEPISSAYFPCLDVGKPDRPNYLPLEFCNLVSLQRYTKPLSGRQRVLLVESSRQKPLERIKTLNDAMHTYCYDKDPFLAGCGISIEKEMTQVEGRVLKPPMLKFGKNEDFQPCNGRWNFNNKMLLEPRAIKSWAIVNFSFPCDSSHISRELISCGMRKGIEIDRPFALVEEDPQYKKAGPVERVEKMIATMKLKFPDPPHFILCILPERKTSDIYGPWKKICLTEEGIHTQCICPIKISDQYLTNVLLKINSKLGGINSLLGIEYSYNIPLINKIPTLILGMDVSHGPPGRADVPSVAAVVGSKCWPLISRYRAAVRTQSPRLEMIDSLFQPIENTEKGDNGIMNELFVEFYRTSRARKPKQIIIFRDGVSESQFEQVLKIEVDQIIKAYQRLGESDVPKFTVIVAQKNHHTKLFQAKGPENVPAGTVVDTKIVHPTNYDFYMCAHAGKIGTSRPAHYHVLLDEIGFSPDDLQNLIHSLSYVNQRSTTATSIVAPVRYAHLAAAQVAQFTKFEGISEDGKVPELPRLHENVEGNMFFC

SEQ ID NO: 71 - DNA, 2973 bp, Arabidopsis thaliana
  G1150,family:PAZ
atggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtgaaggtcaaaagtttcttggaaagctatcagatgatcaagctgcaaagatcatgaaaatgggctgccaaaaacctaatgaaaggaaagctattattgataaggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctga

SEQ ID NO: 72 - protein, 990 aa, Arabidopsis thaliana
  G1150,PAZ domain coordinates 887-907
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 73 - DNA, 1780 bp, Arabidopsis thaliana
  G1198,family:bZIP
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 74 - protein, 481 aa, Arabidopsis thaliana
  G1198,bZIP domain coordinates 173-223
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 75 - DNA, 1374 bp, Arabidopsis thaliana
  misc_feature (1144)..(1144): n is a, c, g, or t
  misc_feature (1209)..(1209): n is a, c, g, or t
  misc_feature (1212)..(1212): n is a, c, g, or t
  misc_feature (1238)..(1238): n is a, c, g, or t
  misc_feature (1254)..(1254): n is a, c, g, or t
  misc_feature (1260)..(1261): n is a, c, g, or t
  misc_feature (1296)..(1296): n is a, c, g, or t
  misc_feature (1322)..(1322): n is a, c, g, or t
  misc_feature (1325)..(1325): n is a, c, g, or t
  misc_feature (1360)..(1360): n is a, c, g, or t
  G1211,family:MISC
tgaaacctagatttctgcaactgaattcctaattcgaaaaagaatggagggttcgtcgtcgacgatagcaaggaagacatgggaactagagaacagcattctaacagtagactcacctgattcaacctccgacaacatcttctactacgacgatacttcacagactaggttccagcaagagaaaccgtgggagaatgatcctcactactttaaacgagtcaagatctcagcgctcgctcttcttaagatggtggttcacgctcgctctggtggtacaattgaaataatgggtcttatgcaaggtaagaccgatggtgatactatcattgttatggatgcttttgctttaccagtggaaggtactgagacaagggttaatgctcaggatgatgcttatgagtacatggttgagtattcacagaccaacaagctcgcggggcggctggagaatgttgttggatggtatcactctcaccctggatatggatgctggctctccggtattgatgtttctacgcagacgcttaaccaacagcatcaggagccatttttagctgttgttattgatcccacaaggactgtttcagctggtaaggttgagattggtgctttcagaacatactctaaaggatataagcctccagatgaacctgtttctgagtatcaaactattcctttaaataagattgaggactttggtgttcactgcaaacagtactattcattagatgtcacttatttcaagtcatctcttgattctcaccttctggatctactatggaacaagtactgggtgaacactctttcttcttctccactgctgggtaatggagactatgttgctggacaaatatcagacttagctgagaagcttgagcaagccgagagtcatctggttcagtctcgctttggaggagttgtgccatcatcccttcataagaaaaaagaagatgagtctcaactaactaagataactcgggatagcgcaaagataactgtggaacaggtccatggactaatgtcgcaggtcataaaagatgaattattcaactcaatgcgtcagtccaacaacaaatctcccactgactcgtcggatccagaccctatgattacatattgaagttgctcttcttttggtttctanttttggattgacccatcatttgttgtcctttcatttattttctgttgtgtaaagaattataatgncgncgcgaattcgcggccgctaaaaaaanacaggaaattgaaaanaattcnnccattccaacatctttatttaatattatctcctcnattatataatattcaaacatccctantancttcatttgaccgtccccctccctcccgtgttgcnttggtgctggcccc

SEQ ID NO: 76 - protein, 358 aa, Arabidopsis thaliana
  G1211,MISC domain coordinates 123-179
MEGSSSTIARKTWELENSILTVDSPDSTSDNIFYYDDTSQTRFQQEKPWENDPHYFKRVKISALALLKMVVHARSGGTIEIMGLMQGKTDGDTIIVMDAFALPVEGTETRVNAQDDAYEYMVEYSQTNKLAGRLENVVGWYHSHPGYGCWLSGIDVSTQTLNQQHQEPFLAVVIDPTRTVSAGKVEIGAFRTYSKGYKPPDEPVSEYQTIPLNKIEDFGVHCKQYYSLDVTYFKSSLDSHLLDLLWNKYWVNTLSSSPLLGNGDYVAGQISDLAEKLEQAESHLVQSRFGGVVPSSLHKKKEDESQLTKITRDSAKITVEQVHGLMSQVIKDELFNSMRQSNNKSPTDSSDPDPMITY

SEQ ID NO: 77 - DNA, 2337 bp, Arabidopsis thaliana
  G1216,family:BPF-1
tgtggcgtttcacagagagagaaagaaataggagattgtttttgcttgtggtgagagaagatcgcatcgtgtgggtagcgtttcaaacaagtaaaataataaaaagaataaaaagtttccgtcactttctcgaggaagaaggggttttggtgtgagtcctttctttgcgtttgtcttttcattttccgatctcgtaattgtcgtgttattcgccggaaaagttaaagattcagatttaaaggttgggaattacattcacagaatttcgttgattggtgtgataataagccattgatcaacaatcttcttttgtggcaatcacataatcgtgttatgcattctgagaaatggtgtcgcataagtgtgtagaagaatttggatacgcaagctacctggtaccttccaatgcaagagcacccagatccgcccggaagaggcgcagtatcgagaagaggataagtaaagaagatgataatatgtgtgcaattgatctattggccaccgtagctggacacttgtcatttgagagtgggagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcagatacgaaaccgtggagaaattattacttgcaccagcagaggagctatcctatcaagaaaaggaaaaactttgaccacatatctgattccgttactgatgattaccgtatgcgtactaagatgcatagaggtagtagaaaaggtcaaggggcatcctttgtggcaagcgactcccatgtgaaactacggatcaagtcgttcagggtgcctgagcttttcatagagattccagaaactgctactgttggctcattgaagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtggagagatgttaagctttgtgctttcgaggatgctgaccaccgcacttacgtagatctcaaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgattatgtaagattctgacatagatgcaaagatttggtcttttactttggtttgatttttttaacttttctcaatgtaaagtttttaactggaataaggtttctctgaccagtttagggcttttagaggatctgttgtacatcttttgtgacattctcattctctttacatatttcttatctagactttttaaa

SEQ ID NO: 78 - protein, 578 aa, Arabidopsis thaliana
  G1216,BPF-1 domain coordinates 293-373,464-550
MVSHKCVEEFGYASYLVPSNARAPRSARKRRSIEKRISKEDDNMCAIDLLATVAGHLSFESGSSLMSIDKLIEDHRVKEEFPEEEKPLMPVALSPYRGSLSPCGFSSVINGKVENEVDGFSYSGGSDACQVGNFSQDVKPDIDGDAVVLDARPNVVVSLGSSSRTEVPSIGNCVSHGVRDDVNLFSRDDDENFSKYIHPRVTKHSPRTVPRIGDRRIRKILASRHWKGGSRHSDTKPWRNYYLHQQRSYPIKKRKNFDHISDSVTDDYRMRTKMHRGSRKGQGASFVASDSHVKLRIKSFRVPELFIEIPETATVGSLKRMVMEAVSTLLSDGHRVGLMVQGKKVRDDNKTLHQTGISQDNSHLDSLDFSLEPSSEMPQLLTSHPLGHACEELLPVCQATKIDNVLESDHHDSALFPSDSLGNNNVTEDSKAMISVALNELSSQSQPPSRKSRRSEQQQQQAAQRRIRRPFSVAEVEALVQAVEKLGTGRWRDVKLCAFEDADHRTYVDLKDKWKTLVHTAKISPQQRRGEPVPQELLNRVLNAHGYWTQQQMQQLQQNVNKLEQETQSQTTEGLLLL

SEQ ID NO: 79 - DNA, 1362 bp, Arabidopsis thaliana
  G1226,family:HLH/MYC
ctgcatttattaagaacagtttagaaagtgtcaacccctaaaggaatgtttttagtttagaggaaagagagagaagaagaagcagcagcagaagttgttaatttgaagactatttgaggaaagacacctatatctaaatactcaaagttacaaaaatattacttcagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgatataaataagaaaaaccaaagaggtgaaattttgggagttttaattattatcttatactttttggattttagattagtagcaaactcgcagtgttctacgatgacattattattggtcacatgaaggtttaggttaaaaaaaaa

SEQ ID NO: 80 - protein, 315 aa, Arabidopsis thaliana
  G1226,HLH/MYC domain coordinates 109-168
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 81 - DNA, 1196 bp, Arabidopsis thaliana
  G1228,family:HLH/MYC
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 82 - protein, 358 aa, Arabidopsis thaliana
  G1228,HLH/MYC domain coordinates 172-231
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 83 - DNA, 1118 bp, Arabidopsis thaliana
  G1231,family:Z-C4HC3
caaacccaaattctctcagcgccggtcaaatacttgtctctctctctctctctctttcactcttgtcttgtctccttcgaagctgtttgttctgtaagaaagatggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagcccaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaaatttgttgaccgctcgcttctgtgtatctacctttgcatatgatgatgaacagcttaactgtttggtttagatcagatttgtcatatggatttggtaatttaggaagacattttagttttttcattgttacattttggcgattgaagggataactctttgtttaggggtaatgatcttttgctctgttttatgtttgtttattaacattcttcaaactcaatcaaaagtattttggttagtcttaaaa

SEQ ID NO: 84 - protein, 255 aa, Arabidopsis thaliana
  G1231,Z-C4HC3 domain coordinates 201-249
MEAGGAYNPRTVEEVFRDFKGRRAGMIKALTTDVQEFFRLCDPEKENLCLYGHPNEHWEVNLPAEEVPPELPEPVLGINFARDGMAEKDWLSLVAVHSDAWLLAVAFFFGARFGFDKADRKRLFNMVNDLPTIFEVVAGTAKKQGKDKSSVSNNSSNRSKSSSKRGSESRAKFSKPEPKDDEEEEEEGVEEEDEDEQGETQCGACGESYAADEFWICCDLCEMWFHGKCVKITPARAEHIKQYKCPSCSNKRARS

SEQ ID NO: 85 - DNA, 1057 bp, Arabidopsis thaliana
  G1233,family:Z-C4HC3
gcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagcatacaaaactctctctttagatctcaagaaagggatttcaagaagttgagggagagagtagcaaactgtttgaataatattattattattcatattaaa

SEQ ID NO: 86 - protein, 246 aa, Arabidopsis thaliana
  G1233,Z-C4HC3 domain coordinates 192-240
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 87 - DNA, 710 bp, Arabidopsis thaliana
  G1240,family:MISC
tcttttctttttgtttcattttcttatctcctcacactcttcgaacaaggaagaaccctaatctcaagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaagaagctagcagaacagttccagaaacaggcttctggtgaaggtaatgccgcctcagcaaccatacaagaagaggatgatgacgatgtcccagagcttgttggagagacattcgaaactgctgctgaagagaaagcaccagctgctgctgcttcttcttagagagaaaagagcgagaccacatccaaaaaaaaaccgcactttgatttttacatatctttataatatgtttgttcgctcgatcctttttgtagtttccgaccagaatcttgttttccatctaatgacttaaggtttttatccaaa

SEQ ID NO: 88 - protein, 165 aa, Arabidopsis thaliana
  G1240,MISC domain coordinates NA
MNREKLMKMANTVRTGGKGTVRRKKKAVHKTNTTDDKRLQSTLKRIGVNSIPAIEEVNIFKDDVVIQFINPKVQASIAANTWVVSGSPQTKKLQDILPQIISQLGPDNMDNLKKLAEQFQKQASGEGNAASATIQEEDDDDVPELVGETFETAAEEKAPAAAASS

SEQ ID NO: 89 - DNA, 3174 bp, Arabidopsis thaliana
  G1243,family:SWI/SNF
atggcgagaaattcgaattccgatgaggctttctcgtcagaggaggaagaagagcgggttaaggataatgaagaagaagatgaggaggagctcgaggctgttgctcgttcttctggctccgacgatgacgaagtagccgccgccgacgaatcaccagtctccgacggagaggctgctcccgtagaagatgattacgaggacgaagaagatgaggaaaaagctgaaatcagcaaacgtgagaaagccagacttaaagagatgcagaagttgaagaagcagaagattcaagagatgctggagtcgcagaatgcttccattgacgcggatatgaacaataagggaaaagggagactgaagtatcttctgcagcaaactgagttatttgcccactttgctaaaagtgatggatcttcttctcagaagaaggcaaaaggaaggggacgtcatgcttccaaaataactgaagaggaggaagacgaagagtatctaaaggaagaagaggatggcttaactggatctggaaacacacggttactcacacagccctcttgtattcaagggaagatgagagattaccaattagctggtttgaactggctcattcgtctttatgagaatggcataaatggaattcttgctgatgaaatgggtctggggaagacgcttcaaacgatttctttgttggcatatcttcatgaatacaggggaatcaatggtccccatatggtggttgctccaaaatcaacacttggtaattggatgaacgaaattcgccggttttgtcctgtcctacgtgctgtgaagttccttggtaatcctgaggagaggagacatattcgagaagacctgctagttgctgggaaatttgatatttgtgtcacaagctttgagatggccatcaaagagaagacagcacttcgtcggtttagctggcgttatattatcattgatgaagcgcatcgaatcaagaacgagaattcactcctttctaaaaccatgagactttttagcaccaattatcggcttcttatcacggggaccccccttcagaataatctccatgaactgtgggctcttctaaattttcttctgcctgagatttttagttcagcagagacttttgatgaatggtttcaaatttctggtgagaatgaccagcaagaagttgtgcaacaactgcacaaggttcttcgaccatttcttcttcgaagactaaagtcagatgttgagaaaggtttgccaccgaagaaggagaccatacttaaagttggtatgtctcagatgcaaaagcaatactacaaggctttactgcagaaggatcttgaagcggttaatgctggtggagaacgcaaacgtctgctaaacattgcaatgcaactgcgtaaatgctgcaatcacccctatctcttccagggtgcagaacctggtcccccatataccacaggagatcaccttataacaaatgctggtaagatggttctcttggataaattgcttcctaagttgaaagaacgtgattcaagggtgctgatattttctcagatgacaagacttttggatattcttgaggactatttaatgtatcgtggttacttgtattgccgtattgatggaaacactggtggtgacgaacgagatgcctccatagaagcctacaacaagccaggaagtgagaaatttgttttcttgttatctactagagctggagggcttggtatcaatcttgctactgcagatgttgtgatcctttacgatagtgattggaacccacaagtcgacttgcaagctcaggatcgtgcccataggattggtcaaaaaaaagaagttcaagtgtttcgattctgcactgagtctgctattgaggagaaagtgattgaaagagcttacaagaagttagcacttgatgctctggttattcaacaagggagattggcagaacagaaaagtaagtctgtcaataaggatgagttgcttcaaatggtaagatatggtgctgagatggtgttcagttctaaagatagcacaatcacagacgaggatattgatagaatcattgccaaaggagaagaggcaacagctgaacttgatgctaagatgaagaaattcacagaagatgctatacagtttaaaatggatgacagtgctgacttctatgattttgatgatgacaataaggatgaaaacaagctcgattttaaaaagattgtaagcgacaattggaatgatccccccaagcgggagagaaagcgcaactactctgaatctgagtactttaagcaaacattgcggcaaggtgctccagctaaacctaaagagcctagaattccgcgcatgccccagttgcacgatttccagttctttaacattcagagattgaccgagttgtatgaaaaggaagtacgttatctcatgcaaacacatcagaaaaatcagttgaaagacacaattgatgttgaagaaccagaaggtggggatcccttaactactgaagaagtagaagaaaaggagggattattggaggagggtttctcaacatggagcagaagagattttaatactttcctcagggcttgtgagaagtatggccgcaacgacataaaaagcattgcctctgagatggaagggaaaacagaggaagaagttgaaagatatgccaaagtatttaaagagcggtacaaggagctgaacgactatgatagaatcattaagaacattgagaggggagaggcaaggatctctaggaaagacgaaatcatgaaggccatagggaagaaactggatcgctacagaaacccttggctggaactgaagattcaatatggtcagaacaaaggcaagctgtacaatgaagagtgtgaccgtttcatgatctgcatgattcacaaacttggttatgggaattgggatgagctaaaggcagcatttaggacatcgtctgtgttcaggtttgactggtttgtgaaatcccgcacgagtcaggaacttgcaagaagatgcgacactctgattcgactgatcgagaaagagaaccaggagtttgatgaaagagagaggcaagcccgcaaagagaagaagctcgcgaagagtgcaacaccatcaaagcgacctttaggaagacaagcaagtgagagtccttcatcgacgaagaagcggaagcacctgtcgatgagatga

SEQ ID NO: 90 - protein, 1057 aa, Arabidopsis thaliana
  G1243,SWI/SNF domain coordinates 185-377,520-604,842-891,944-1005
MARNSNSDEAFSSEEEEERVKDNEEEDEEELEAVARSSGSDDDEVAAADESPVSDGEAAPVEDDYEDEEDEEKAEISKREKARLKEMQKLKKQKIQEMLESQNASIDADMNNKGKGRLKYLLQQTELFAHFAKSDGSSSQKKAKGRGRHASKITEEEEDEEYLKEEEDGLTGSGNTRLLTQPSCIQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEWFQISGENDQQEVVQQLHKVLRPFLLRRLKSDVEKGLPPKKETILKVGMSQMQKQYYKALLQKDLEAVNAGGERKRLLNIAMQLRKCCNHPYLFQGAEPGPPYTTGDHLITNAGKMVLLDKLLPKLKERDSRVLIFSQMTRLLDILEDYLMYRGYLYCRIDGNTGGDERDASIEAYNKPGSEKFVFLLSTRAGGLGINLATADVVILYDSDWNPQVDLQAQDRAHRIGQKKEVQVFRFCTESAIEEKVIERAYKKLALDALVIQQGRLAEQKSKSVNKDELLQMVRYGAEMVFSSKDSTITDEDIDRIIAKGEEATAELDAKMKKFTEDAIQFKMDDSADFYDFDDDNKDENKLDFKKIVSDNWNDPPKRERKRNYSESEYFKQTLRQGAPAKPKEPRIPRMPQLHDFQFFNIQRLTELYEKEVRYLMQTHQKNQLKDTIDVEEPEGGDPLTTEEVEEKEGLLEEGFSTWSRRDFNTFLRACEKYGRNDIKSIASEMEGKTEEEVERYAKVFKERYKELNDYDRIIKNIERGEARISRKDEIMKAIGKKLDRYRNPWLELKIQYGQNKGKLYNEECDRFMICMIHKLGYGNWDELKAAFRTSSVFRFDWFVKSRTSQELARRCDTLIRLIEKENQEFDERERQARKEKKLAKSATPSKRPLGRQASESPSSTKKRKHLSMR

SEQ ID NO: 91 - DNA, 1746 bp, Arabidopsis thaliana
  G1246,family:MYB-(R1)R2R3
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 92 - protein, 581 aa, Arabidopsis thaliana
  G1246,MYB-(R1)R2R3 domain coordinates 27-139
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 93 - DNA, 1245 bp, Arabidopsis thaliana
  G1247,family:MYB-(R1)R2R3
atgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatga

SEQ ID NO: 94 - protein, 414 aa, Arabidopsis thaliana
  G1247,MYB-(R1)R2R3 domain coordinates 18-141
MIQDQANDLLAMKKTFTKSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWNARRMRLKGKGLPVYPDEVREQAIRTAAQYGVKVELLNAHYSQDSLMAGNVEKPQELNNLALNQCSPYYQSTLANVQPSRNRVMEPETTFPFTGGSAMNEQNPTLLCNPYVESTQEQLPDSHLFGNVTYSSPPMPLIHEVENLELPSFQGFDFHEEPSSFGAEQYNPMLNLEPHNTLVQSPLIGQTPTDFPSSFYDELLDELLESVVNGSLGEIPKTDTSSESQLFQSSLRSHTDATPDIANTTGKPFLVSTHYITITSFFVCSIQEVSTNLYA

SEQ ID NO: 95 - DNA, 738 bp, Arabidopsis thaliana
  G1249,family:CAAT
tcgaccgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaagcggcc

SEQ ID NO: 96 - protein, 130 aa, Arabidopsis thaliana
  G1249,CAAT domain coordinates 13-89
MEEEEGSIRPEFPIGRVKKIMKLDKDINKINSEALHVITYSTELFLHFLAEKSAVVTAEKKRKTVNLDHLRIAVKRHQPTSDFLLDSLPLPAQPVKHTKSVSDKKIPAPPIGTRRIDDFFSKGKAKTDSA

SEQ ID NO: 97 - DNA, 1500 bp, Arabidopsis thaliana
  G1256,family:Z-C2H2
atgtcttcatcgtacaacacaattgctttgtcctccactccgaccttcctcctctcaagtgccgctgccggacccggaccaaacaactttaaccgtcaagaggctgcgatgaccatggttcaacaacaacccacttcctccgttgctccaccacccaagaagcgaaggaaccaacccggaaacccaagcaagttcctatgtgaagtgtgcaacaaagggttccagagggaacagaatctgcagctccacaggaggggacacaaccttccatggaagctgaaacaaaagtccaacaaagaggtgaggaggaaggtgtacctttgtccggagccctcgtgcgtccaccatgaccccgcacgtgctctcggagacctcaccggaatcaagaagcattactatcggaagcacggtgagaaaaagtggaagtgcgataagtgctctaagcgttacgctgttcaatctgattggaaagctcactctaagacctgtggtaccaaagagtatcgatgtgactgtggtaccatcttctctagtgaaagagagaaagacagtgaaggagaaaggggaaaaattaaagatgccaaatttggtcacattggttggtttcattgtttaatcgatgaacatggtggtcagcgtgatatagtaggagtagttgatgaacactttacatttctagggagagacagttacatcacccacagggcattctgtgatgcactcatacaggagtcagcaagaaaccccaccgtgagcttcacggcaatggcagctggtggtggtggtggcgccagacatggcttttacggcggagcttcttccgctctctctcacaaccatttcggtaacaatccaaattccggtttcacccctctagctgctgcaggctacaatctgaaccgttcatcttccgacaagttcgaagacttcgttcctcaggccaccaaccctaatcccggtccgaccaacttcctcatgcaatgctctccgaaccaaggactgttagcccagaacaatcagagtctcatgaaccatcatggtctgatcagcctcggtgataacaacaacaacaaccacaactttttcaacctcgcatactttcaagacaccaagaattctgatcagacaggtgttccttctctgttcaccaatggtgctgataacaacggcccatctgctttgcttagagggctaacttcttcatcttcgtcaagtgtggtcgttaatgactttggagattgtgatcatggaaaccttcaaggactcatgaactctctagctgcgacaacagatcaacaaggccggtcccctagccttttcgaccttcatttcgcaaacaatcttagcatgggtggctcggataggttgactttggactttcttggtgttaatggaggaattgtgagcaccgtcaatggccgtggtggtcgtagtggtggacctcctctggatgctgagatgaagttttcacacccaaatcatccatatggcaaagcttga

SEQ ID NO: 98 - protein, 499 aa, Arabidopsis thaliana
  G1256,Z-C2H2 domain coordinates 67-87,143-163
MSSSYNTIALSSTPTFLLSSAAAGPGPNNFNRQEAAMTMVQQQPTSSVAPPPKKRRNQPGNPSKFLCEVCNKGFQREQNLQLHRRGHNLPWKLKQKSNKEVRRKVYLCPEPSCVHHDPARALGDLTGIKKHYYRKHGEKKWKCDKCSKRYAVQSDWKAHSKTCGTKEYRCDCGTIFSSEREKDSEGERGKIKDAKFGHIGWFHCLIDEHGGQRDIVGVVDEHFTFLGRDSYITHRAFCDALIQESARNPTVSFTAMAAGGGGGARHGFYGGASSALSHNHFGNNPNSGFTPLAAAGYNLNRSSSDKFEDFVPQATNPNPGPTNFLMQCSPNQGLLAQNNQSLMNHHGLISLGDNNNNNHNFFNLAYFQDTKNSDQTGVPSLFTNGADNNGPSALLRGLTSSSSSSVVVNDFGDCDHGNLQGLMNSLAATTDQQGRSPSLFDLHFANNLSMGGSDRLTLDFLGVNGGIVSTVNGRGGRSGGPPLDAEMKFSHPNHPYGKA

SEQ ID NO: 99 - DNA, 859 bp, Arabidopsis thaliana
  G1266,family:AP2
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 100 - protein, 218 aa, Arabidopsis thaliana
  G1266,AP2 domain coordinates 79-147
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 101 - DNA, 2793 bp, Arabidopsis thaliana
  G1272,family:PAZ
atggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaa

SEQ ID NO: 102 - protein, 930 aa, Arabidopsis thaliana
  G1272,PAZ domain coordinates 800-837
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATSKDFVSRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 103 - DNA, 1548 bp, Arabidopsis thaliana
  G1273,family:WRKY
tcagattttcttcgttccctaactcctaaaaaggagagattcttcaaatccttatcacaacttcagtttttgcattcaccgtcgtgagtgttctacttttggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggctgaagtaaaaggtattggaaatggaatgtcttgtgatgatgattcagatagcagaaactacgtcgtttataaaccgaaagcaaagcttgtctccaaagcaaccgtctctgcattggctaatatggggaatcgtcaacaaacttggagacaaagcgaagcagtatcctatgggaagagtgtgagccaaggtacacatcgagcaggtcctaatctagtccagaaagttccatcttttacggaatcagagacatctactggggatagatcttctgtggatggatacaactggaggaaatacggacagaagcaagttaaaggaagtgagtgtccaaggagttattacaaatgcacacacccgaaatgtccggtgaagaagaaagtagagagatcagtggaaggtcaagtttcagagattgtgtatcaaggtgaacataatcactcaaagccatcttgtcctcttccacggcgtgcttcatcatcaatctcttcagggtttcaaaaaccaccaaaatcgattgcttctgaaggatcaatgggacaagaccctaacaataatctctattctcctctatggaacaatcaaagcaatgactctactcaaaacagaacagagaagatgagtgaaggttgtgttattacaccatttgagtttgctgttccaagatcgacaaattcaaatcccggaacttcagattccggttgcaagagtagccaatgtgatgaaggagagcttgatgatccaagcagaagcaaaagaaggaagaacgagaagcaatctagtgaagcaggagtatcgcaaggctcagtggaatcagacagtcttgaagatggattcaggtggagaaagtatggacaaaaagtggtaggaggcaatgcgtatccaagaagttattacagatgcacaagtgctaattgcagagcaaggaaacatgttgaacgagcgagtgatgatccaagagctttcattacaacctacgagggtaaacataatcatcatttgctcttgagccctccatcttcctctactcttccctttaactccccacaactttctaagcaaacaatttgatttgatgatccattcatgctttttcttttttctttttctttttttgttaagaatgagaaaaaagaagaagcaaatggtaaatacaatcaccatttgctcttcactcacaacttcctaagcaaaagccatttgatcaattcatgcctgtttcttca

SEQ ID NO: 104 - protein, 427 aa, Arabidopsis thaliana
  G1273,WRKY domain coordinates 163-218,347-403
MEVNDGERVVIAKPVASRPSSSSGFRTFTELLTDSVTVSPQTTCHEIVDAAIRPKTLRFNQPVAASVSCPRAEVKGIGNGMSCDDDSDSRNYVVYKPKAKLVSKATVSALANMGNRQQTWRQSEAVSYGKSVSQGTHRAGPNLVQKVPSFTESETSTGDRSSVDGYNWRKYGQKQVKGSECPRSYYKCTHPKCPVKKKVERSVEGQVSEIVYQGEHNHSKPSCPLPRRASSSISSGFQKPPKSIASEGSMGQDPNNNLYSPLWNNQSNDSTQNRTEKMSEGCVITPFEFAVPRSTNSNPGTSDSGCKSSQCDEGELDDPSRSKRRKNEKQSSEAGVSQGSVESDSLEDGFRWRKYGQKVVGGNAYPRSYYRCTSANCRARKHVERASDDPRAFITTYEGKHNHHLLLSPPSSSTLPFNSPQLSKQTI

SEQ ID NO: 105 - DNA, 585 bp, Arabidopsis thaliana
  G1274,family:WRKY
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 106 - protein, 194 aa, Arabidopsis thaliana
  G1274,WRKY domain coordinates 110-166
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 107 - DNA, 748 bp, Arabidopsis thaliana
  G1275,family:WRKY
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 108 - protein, 173 aa, Arabidopsis thaliana
  G1275,WRKY domain coordinates 113-169
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 109 - DNA, 1334 bp, Arabidopsis thaliana
  G1278,family:bZIP
ggcgattgggtaagcgatgcacatcgtcttctctgtcgatgatttgaccgaatccttctggcctgttcccgctccggcgccgtcgccgggatcgtcatcgactccgtcaccgacgcagaacgtggcggatgggatgactcgaagtcaatcggagtgggcgttccacaggcttatcaatgagttgtctggttccgattcgagccctacgactaacacaatcgagagatcacctccaccggttcagtctctttcgagattagaagaaaccgttgacgaaaccgaagatgttgttgagattcagaaaccgcagaatcatcgacggctccctgttgatgatcaagggaagaatcggaatcgtgctccgtcgtctgatccggttgattcttcagctcctgttgttgttgatcctaatcagtatcatgcgattcttaagagcaagctcgagcttgcttgcgctgctgttgctcgtcgtgtgggaactgtgaaaccggaagattcgagtgcttcagctagcaatcaaaaacaagctcaaggctccattgtggcacaaacctcacctggtgcttcatctgttagattttctcccacaacaagcacgcaaaagaaacctgatgttccagccagacaaactagtatttcatcacgagatgattctgatgacgatgatcttgatggagacgcagataatggagatcctactgatgtgaagcgtgctaggaggatgctctcaaaccgagaatccgctaggcgctctaggagaagaaagcaagaacaaatgaatgaatttgatacacaggtaggccaattaagagccgagcattcaactttaattaatcgtcttagtgacatgaatcataagtatgatgcagctgctgttgacaacagaattctaagagctgatatcgaaactttgagaacaaaggttaagatggcagaggaaactgtgaaaagagtgacaggagtgaaccctttgcattggtcaagaccaaacatgggcataccattcagcaacacaccgagtgcttcctctagtattccgccaaactctaaccacattttgaaaccagcaaattcaagtaccaacaccagtgctggtttagcacaaaatcagagagtggagacggcaaattttttgccggaacaggtgaaccgtgaaggcatgcagaatccatttgctcctgattttaatctgtatgaaaccctaccccattggaatcccaagcattaaccagaaaaagagtcattggttttgtgattttgattgaggtaactattgtctgtatttttatttactgtatgactcagcgacggtaaactcttaatattatatatat

SEQ ID NO: 110 - protein, 403 aa, Arabidopsis thaliana
  G1278,bZIP domain coordinates 230-328
MHIVFSVDDLTESFWPVPAPAPSPGSSSTPSPTQNVADGMTRSQSEWAFHRLINELSGSDSSPTTNTIERSPPPVQSLSRLEETVDETEDVVEIQKPQNHRRLPVDDQGKNRNRAPSSDPVDSSAPVVVDPNQYHAILKSKLELACAAVARRVGTVKPEDSSASASNQKQAQGSIVAQTSPGASSVRFSPTTSTQKKPDVPARQTSISSRDDSDDDDLDGDADNGDPTDVKRARRMLSNRESARRSRRRKQEQMNEFDTQVGQLRAEHSTLINRLSDMNHKYDAAAVDNRILRADIETLRTKVKMAEETVKRVTGVNPLHWSRPNMGIPFSNTPSASSSIPPNSNHILKPANSSTNTSAGLAQNQRVETANFLPEQVNREGMQNPFAPDFNLYETLPHWNPKH

SEQ ID NO: 111 - DNA, 1476 bp, Arabidopsis thaliana
  G1293,family:AKR
atgagcaatcttgaagaatctttgagatctctatcgttggatttcctgaacctactaatcaacggtcaagctttctccgacgtgactttcagcgttgaaggtcgtttagtccacgctcaccgttgtatcctcgccgcacggagtcttttcttccgcaaattcttttgtgggacagactcaccacaacctgtcacaggtatagacccgacccaacatgggtccgtacccgctagcccaacaagaggctccacggccccagctggaattataccagtgaactcagtcggttatgaggtttttctgttgctacttcagtttctttatagcggacaagtctccatcgtgccgcagaaacacgagcctagacctaattgtggcgagagaggatgttggcacactcattgctcagccgccgttgatcttgctcttgatactctcgccgcctctcgttacttcggcgtcgagcagctcgcattgctcacccagaaacaattggcaagcatggtggagaaagcctctatcgaagatgtgatgaaagttttaatagcatcaagaaagcaagacatgcatcaattatggaccacctgctctcacttagttgctaaatcaggtctcccaccagagattcttgccaagcatctccctattgacgtcgtcaccaaaatagaagagcttcgtcttaaatcttctatagctcgccgttctctaatgcctcacaaccaccaccatgatctcagcgtggctcaagacctagaagatcaaaagattagaaggatgagacgagctttggattcatcagacgtggaactagtgaagctgatggtaatgggagaaggactcaatcttgatgagtcgttagcattgcattacgctgttgaaagctgtagtagagaagttgtgaaggctttgcttgagcttggagctgccgatgtgaattatccggcgggtccggcagggaaaacacctttgcacatcgcggctgagatggtctctccagacatggtggctgttctgttagaccaccatgctgatcctaatgtgaggacagttggtggaatcacgcctcttgatatccttagaacattaacttcggatttcttgttcaagggggcagttcctggattgactcacattgaaccgaataaacttaggctttgcctcgagcttgttcaatccgctgcaatggtgatatctcgagaagaaggaaacaatagcaacaaccaaaacaatgataacaataccgggatttaccctcatatgaatgaggagcacaatagtggaagcagtggagggagcaataacaatttggattcaagattggtttatctcaatcttggagcaggtacgggtcagatgggtccaggtcgagatcaaggggatgaccataacagtcagagggaaggtatgagtcggcatcatcatcatcatcaagacccatctacaatgtatcatcaccatcatcaacatcacttctag

SEQ ID NO: 112 - protein, 491 aa, Arabidopsis thaliana
  G1293,AKR domain coordinates NA
MSNLEESLRSLSLDFLNLLINGQAFSDVTFSVEGRLVHAHRCILAARSLFFRKFFCGTDSPQPVTGIDPTQHGSVPASPTRGSTAPAGIIPVNSVGYEVFLLLLQFLYSGQVSIVPQKHEPRPNCGERGCWHTHCSAAVDLALDTLAASRYFGVEQLALLTQKQLASMVEKASIEDVMKVLIASRKQDMHQLWTTCSHLVAKSGLPPEILAKHLPIDVVTKIEELRLKSSIARRSLMPHNHHHDLSVAQDLEDQKIRRMRRALDSSDVELVKLMVMGEGLNLDESLALHYAVESCSREVVKALLELGAADVNYPAGPAGKTPLHIAAEMVSPDMVAVLLDHHADPNVRTVGGITPLDILRTLTSDFLFKGAVPGLTHIEPNKLRLCLELVQSAAMVISREEGNNSNNQNNDNNTGIYPHMNEEHNSGSSGGSNNNLDSRLVYLNLGAGTGQMGPGRDQGDDHNSQREGMSRHHHHHQDPSTMYHHHHQHHF

SEQ ID NO: 113 - DNA, 2785 bp, Arabidopsis thaliana
  G1297,family:ENBP
tggaattaacgacgttcgaagaaactccagaggtctcttcattttccttttgtatactggtaaaaattggtggtctcttctttgtctccgagtatggagaaaatgagagggaagcgaatcagaccaagagattccggcgagttagtcgaagatgggagatctgaaagcgagcgtaagacgaggaagaaagagaatgatgttgtgagcaaaggaagaatcggaagaggaagaggaagaggagaggtttcgaagcgatctattgaaatagacatttctaatcccgagaaggatattaagcctgacggaagcagaaagtgtttgggttcgacgtgtcatcattgtaagatcttgacgagtgagagtgatcttatcttctgttcaaagtgtaacaagaagtgttattgctttgactgcatcaagagatcgtattcagaaagaacacatgaggaagttagagctgcttgtccattctgtatgatgacttgcatttgcagagcttgtttgcggttgcctttggttatcaagcctccaagtgaaaaagatacagatgtcaagcttaagcagctgcagtatctgttagtcaaagttctcccagttcttaaggatatttatacggagcagaaccgtgaactagagattgaatcaacaattagaggacaccctgtgacagaagctaatatcaagaggtgcaaacttgacccaagcgaacgcatatactgtgatctctgccgcacatccattgccaattttcacagaagctgtccgaacaaaaattgttcagtcgatatatgtctttcttgctgcaaggaactaagtgagggcttccatcaagagagagatgggaagaaaaatgcagaagggaaaggatatgaatgtcgaatcccagcaggtcaaggaaaagactcggacgcatatgttccactgcatttctcgacttggaagcttaactcagacagtagcattccatgccctccaaaagagtgtggtggttgtggtacttcaacactggagttgagacgcttatggaaaagagattgggttgaaaaattaataacgaatgccgagaaatgtactctgaattttaggccaacagatgtggatattgttcatgaatgttcctcatgctctaccaattctgattccattagaaggcaggcagcttttaggaagaatgctcatgataatttcttatactccccaaatgctgttgatctggctgaagacgatattgctcattttcagtttcattggatgaaggcagaacctgtgatagtcagaaatgttctcgagaagacatctggactaagttgggaaccaatggttatgtggagggcttgtagggaaatggatccaaagcgtaaaggtacagaagaagagacaacaaaagtgaaagctttggattgcttggactggtgtgaggttgaaataaatctgcatcagttttttgagggctacttagaaggccgcatgcataaaaacggttggccagaaatgttgaaattgaaggactggcctccctcagatttatttgaaaagcgccttccaaggcataatgctgagtttattgccgcattgcctttctttgattacactgacccaaagtctggtatcctaaatctcgcaacaagatttccggaaggatccttgaagccagatcttggacccaagacatacattgcgtacggtttccatgaagagcttaatagaggagattcggtgacaaaacttcattgtgacatttctgacgcggtcaatgtgttgacacacacagctaaagtggaaatccctcccgtcaaataccaaaacataaaagtacatcagaaaaaatatgcagaagccatgttgcagaaacaacaatacagtggtcaagtgaaagaagccagcgaacttgaaaacaagtcaatgaaagaagtggatgaaagtaaaaaggatttaaaagacaaggcagctaacgaagaacaatcaaataacagttcaagaccgtcgggctcaggagaagctgagaaagtaattatttcaaaagaggataatcccacacaacctgctgtgagtacaagtgtggaatccatacaagaacagaagctggatgctccaaaagaaactgatggcaataccaatgagaggtcaaaggctgtgcatggtggtgctgtctgggatatctttcgaagagaggatgttccaaaacttattcagtttttgaaaaggcacgagcatgagtttcgtcacttcaataacgaacccctggaatccgttattcacccaattcatgaccagactatgttcttgagtgatagccagaagaaacagctgaaagaagaatttgatatagaaccatggacctttgagcaacacctcggcgaagcagtcttcatacctgcaggttgtcctcaccaagtgaggaatagacagtcttgcataaaggtggcactagactttgtggctcctgaaagcgtcgaagaatgccttaggctaacacaggagttccggagattgcctaaagaccacagttctagcgaggataaattggagcttaagaaaattgcactgtatgctgcgagttcagccataagagaggtaaaagggctaatgcaaagctcccgacgcagtgatacctaacaaatgacaaggaaaagttcccaagtttattttatccctaaactattcctacgcagttgacttgttgtaacttcctctactttaaaatagtagagttggatagagtgtaatgtataattaccatgattaccgagtagtagaattatgtaaaagaaaaaaaaaaaaaaaa

SEQ ID NO: 114 - protein, 837 aa, Arabidopsis thaliana
  G1297,ENBP domain coordinates 77-124,480-795
MRGKRIRPRDSGELVEDGRSESERKTRKKENDVVSKGRIGRGRGRGEVSKRSIEIDISNPEKDIKPDGSRKCLGSTCHHCKILTSESDLIFCSKCNKKCYCFDCIKRSYSERTHEEVRAACPFCMMTCICRACLRLPLVIKPPSEKDTDVKLKQLQYLLVKVLPVLKDIYTEQNRELEIESTIRGHPVTEANIKRCKLDPSERIYCDLCRTSIANFHRSCPNKNCSVDICLSCCKELSEGFHQERDGKKNAEGKGYECRIPAGQGKDSDAYVPLHFSTWKLNSDSSIPCPPKECGGCGTSTLELRRLWKRDWVEKLITNAEKCTLNFRPTDVDIVHECSSCSTNSDSIRRQAAFRKNAHDNFLYSPNAVDLAEDDIAHFQFHWMKAEPVIVRNVLEKTSGLSWEPMVMWRACREMDPKRKGTEEETTKVKALDCLDWCEVEINLHQFFEGYLEGRMHKNGWPEMLKLKDWPPSDLFEKRLPRHNAEFIAALPFFDYTDPKSGILNLATRFPEGSLKPDLGPKTYIAYGFHEELNRGDSVTKLHCDISDAVNVLTHTAKVEIPPVKYQNIKVHQKKYAEAMLQKQQYSGQVKEASELENKSMKEVDESKKDLKDKAANEEQSNNSSRPSGSGEAEKVIISKEDNPTQPAVSTSVESIQEQKLDAPKETDGNTNERSKAVHGGAVWDIFRREDVPKLIQFLKRHEHEFRHFNNEPLESVIHPIHDQTMFLSDSQKKQLKEEFDIEPWTFEQHLGEAVFIPAGCPHQVRNRQSCIKVALDFVAPESVEECLRLTQEFRRLPKDHSSSEDKLELKKIALYAASSAIREVKGLMQSSRRSDT

SEQ ID NO: 115 - DNA, 1100 bp, Arabidopsis thaliana
  G1303,family:Z-C4HC3
ttggaaaccattgatgcagacctcaatccatctctaacaccactgatctatctacttaggtcttctctaacaatacttgtaattttctttctttttgcttcttccgtcactacatctatggccgctgagtcttctaaccctcgcaccgtcgaagagatcttcaaggattttagcggtcgtcgctccggttttcttcgagctctctccgtagatgttgacaagttctactctttatgcgatccggaaatggagaatctgtgtttgtacggacacccgaatgggacatgggaagtgaatcttccagctgaggaagtgcctccggagctacctgagccagctcttggaatcaatttcgctagagatggtatgcagcgtaaagattggctctctttagttgctgtccacagtgattgttggttactctctgtttcttcttacttcggcgctcgtcttaatcgcaatgagaggaaacgtctatttagtctgatcaacgatctcccaactctctttgaagtagtgacgggtaggacacccatcaaagacggtaaaccaagcatggatctcggaagcaaatccagaaacggcgtaaagagatcaattgaagggcagacaaagagcacgccgaaactaatggaagagagctatgaagatgaagacgatgagcatggagacacactctgtggaagttgtggaggaaactacacaaacgacgagttctggatatgttgtgatgtgtgtgaacgttggtaccatgggaagtgtgtgaagataacaccagccaaagcagagagcatcaagcaatacaaatgcccttcttgctgcactaagaaaggaagacagtgagtgaatgaatgaattctcaaaaagggcgttttaaaatagtaatgagggtatgagacatggagagagtcatagagacaccagctgcttagagagcttcgtcaacttttgatcaaatatgccatgtgtttgtatatgtagcgactctactactttcatcgtttatgtgtgtaatctctctttaggctaatataaaaaaaaatattcttatgtaaggttgatcttcataatctctcatatggtattttaactaaaaaaaa

SEQ ID NO: 116 - protein, 241 aa, Arabidopsis thaliana
  G1303,Z-C4HC3 domain coordinates 187-235
MAAESSNPRTVEEIFKDFSGRRSGFLRALSVDVDKFYSLCDPEMENLCLYGHPNGTWEVNLPAEEVPPELPEPALGINFARDGMQRKDWLSLVAVHSDCWLLSVSSYFGARLNRNERKRLFSLINDLPTLFEVVTGRTPIKDGKPSMDLGSKSRNGVKRSIEGQTKSTPKLMEESYEDEDDEHGDTLCGSCGGNYTNDEFWICCDVCERWYHGKCVKITPAKAESIKQYKCPSCCTKKGRQ

SEQ ID NO: 117 - DNA, 720 bp, Arabidopsis thaliana
  G1305,family:MYB-(R1)R2R3
atggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctag

SEQ ID NO: 118 - protein, 239 aa, Arabidopsis thaliana
  G1305,MYB-(R1)R2R3 domain coordinates 15-118
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRLVKRSISSSSSDVTNHSVSSTSSSSSSISSVLQDVIIKSERPNQEEEFGEILVEQMACGFEVDAPQSLECLFDDSQVPPPISKPDSLQTHGKSSDHEFWSRLIEPGFDDYNEWLIFLDNQTC

SEQ ID NO: 119 - DNA, 1292 bp, Arabidopsis thaliana
  misc_feature (11)..(11): n is a, c, g, or t
  G1308,family:MYB-(R1)R2R3
ctttgattccnatcttcttctcttaattttcactttgggctttctctgtctctcctattatgagtctaaaagtctactagctgttcaatagttttgtctttctgtgtttctcttcttcaaaaccgaaagaaattcaaaaagagtctttcgctgcttgttagtggggtgaggaacaaatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctcaacaaattcttggggagggaaagaggttactgtggcgattcatggctcagattattctccatattcaaatgatcttgaagatgattcaacagactctgctcttcaacttctgcttgatttccctataagcgatgatgatatgagcttcttggaagagaacattgacagctactcacaggctcctcctattggtcttgtttccatggtttccaaattctagtcttatgagagcctaatatctaagaaaaagattcaaactttgcttccttttggtttttagtgatgataagtagggatatagtatctatgtaaatcagcattagttagttgaagtacttaatcaaccctttcttttatgatttgatcatgtttgagaaaattgcagaacattaaacaattaaccattcaaaaaaaaaaaaaaaaaaaaaaaaaaaaa

SEQ ID NO: 120 - protein, 299 aa, Arabidopsis thaliana
  G1308,MYB-(R1)R2R3 domain coordinates 1-128
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEPLPSYGLAKQAPSSPTTRHMAQWESARVEAEARLSRESMLFSPSFYSGVVKTECDHFLRIWNSEIGEAFRNLAPLDESTITSQSPCSRATSTSSALLKSSTNSWGGKEVTVAIHGSDYSPYSNDLEDDSTDSALQLLLDFPISDDDMSFLEENIDSYSQAPPIGLVSMVSKF

SEQ ID NO: 121 - DNA, 912 bp, Arabidopsis thaliana
  G1309,family:MYB-(R1)R2R3
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 122 - protein, 268 aa, Arabidopsis thaliana
  G1309,MYB-(R1)R2R3 domain coordinates 13-115
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 123 - DNA, 1356 bp, Arabidopsis thaliana
  G1313,family:MYB-(R1)R2R3
atgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttga

SEQ ID NO: 124 - protein, 451 aa, Arabidopsis thaliana
  G1313,MYB-(R1)R2R3 domain coordinates 32-135
MSYTSTDSDHNESPAADDNGSDCRSRWDGHALKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRRQRAGLPLYPPEMHVEALEWSQEYAKSRVMGEDRRHQDFLQLGSCESNVFFDTLNFTDMVPGTFDLADMTAYKNMGNCASSPRYENFMTPTIPSSKRLWESELLYPGCSSTIKQEFSSPEQFRNTSPQTISKTCSFSVPCDVEHPLYGNRHSPVMIPDSHTPTDGIVPYSKPLYGAVKLELPSFQYSETTFDQWKKSSSPPHSDLLDPFDTYIQSPPPPTGGEESDLYSNFDTGLLDMLLLEAKIRNNSTKNNLYRSCASTIPSADLGQVTVSQTKSEEFDNSLKSFLVHSEMSTQNADETPPSELLFTLPSLEIVC

SEQ ID NO: 125 - DNA, 1011 bp, Arabidopsis thaliana
  G1315,family:MYB-(R1)R2R3
tttttcttttcccttcttctctttcaaaaaacaaaacaaagatatctcaaccggaacacttagaccaagagagacagatagagagatgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgcgaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgatttaatctccaaa

SEQ ID NO: 126 - protein, 297 aa, Arabidopsis thaliana
  G1315,MYB-(R1)R2R3 domain coordinates 14-115
MGRAPCCDKANVKRGPWSPEEDAKLKDYIEKQGTGGNWIALPHKAGLRRCAKSCRLRWLNYLRPNIRHGDFTEEEDNIIYSLFASIGSRWSVIAAHLQGRTDNDIKNYWNTKLKKKLIATMAPPPHHHLAIATSSSSASPSSSSHYNMINSLLPYNPSTNQLLTPHQGIMMTMMGQQQQLFYQEDMGNLVNSPNRNNLIMSHQEDNQEQSTNKGIMLLSDVRSGSSTTSTVTRVKMEHRDHDDHHHHEEDERSMTSVVMEDYGMEEIKQLISSSCTSSNNSLWFDENKTEDKFMLYY

SEQ ID NO: 127 - DNA, 1142 bp, Arabidopsis thaliana
  G1319,family:MYB-(R1)R2R3
catcaatacattaccaagaaaccagagtttttcttcattgttcttttccacagcattgcaacatgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgtgaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatcaaatgttctatttggccatacgttaaaaaaataaaaaagcacaatcctttcctgaaaaaaaaaaaaaaaaaaaaaaaaaaaaaa

SEQ ID NO: 128 - protein, 314 aa, Arabidopsis thaliana
  G1319,MYB-(R1)R2R3 domain coordinates 14-114
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNCESNSGTTSHLNNPGMEEMKWSEEYLNESLFSTQVYVKSETDFNSNIAFPWSQSQACDVFPKDLQRMAFSFGGQTL

SEQ ID NO: 129 - DNA, 1020 bp, Arabidopsis thaliana
  G1320,family:MYB-(R1)R2R3
gaagatcataaagatcaaaaggagagaggtattaaaaaatgatgtgtagtcgaggccattggagacctgcagaagacgagaagctaagagaactcgtcgagcaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgcctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagtccttgaccggaaagatcgggttcagaaatagtactactccaatacaagaaggagcaatagaccaaactaaacgaccgatggagttctacaattttctccaagtaaacacggattcgaagatacacgaattgatagataattcaagaaaagacgaagaagaagatgtcgatcaaaacaaccgaattcgtaacgagaattgtgttccatttttcgactttttgtctgttggaaactctgcctctcagggtttatgttaatttgtccgtaccacatgtactataaggtggaccatatgttaactaaagataatgtagaaagtactaatcaattagagctcctgtttgagccaaatgtgaaaattagttaagacatcccaaacattttcttgtataacacatataaggttgtacttttatcaggtctaattttctatttttattttaaggatgtttaatcagacccataaccattcgataaaaaaaaaaaaaa

SEQ ID NO: 130 - protein, 249 aa, Arabidopsis thaliana
  G1320,MYB-(R1)R2R3 domain coordinates 5-108
MMCSRGHWRPAEDEKLRELVEQFGPHNWNAIAQKLSGRSGKSCRLRWFNQLDPRINRNPFTEEEEERLLAPHRIHGNRWSVIARFFPGRTDNAVKNHWHVIMARRGRERSKLRPRGLGHDGTVAATGMIGNYKDCDKERRLATTTAINFPYQFSHINHFQVLKESLTGKIGFRNSTTPIQEGAIDQTKRPMEFYNFLQVNTDSKIHELIDNSRKDEEEDVDQNNRIRNENCVPFFDFLSVGNSASQGLC

SEQ ID NO: 131 - DNA, 1137 bp, Arabidopsis thaliana
  G1324,family:MYB-(R1)R2R3
cgaaaacaccacaaaccaaatatcattaagtaattaggaaacttaaactaagtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgttaaatttgtatcttctttgttgcgagtacttactaagtcattggataaatatttataatgatagtttcttgtacaaaaaaaaaaa

SEQ ID NO: 132 - protein, 286 aa, Arabidopsis thaliana
  G1324,MYB-(R1)R2R3 domain coordinates 20-118
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 133 - DNA, 880 bp, Arabidopsis thaliana
  G1326,family:MYB-(R1)R2R3
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 134 - protein, 250 aa, Arabidopsis thaliana
  G1326,MYB-(R1)R2R3 domain coordinates 18-121
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 135 - DNA, 965 bp, Arabidopsis thaliana
  G1335,family:Z-CLDSH
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 136 - protein, 203 aa, Arabidopsis thaliana
  G1335,Z-CLDSH domain coordinates 24-43,131-144,185-203
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 137 - DNA, 2074 bp, Arabidopsis thaliana
  G1341,family:BZIPT2
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgactttt

SEQ ID NO: 138 - protein, 640 aa, Arabidopsis thaliana
  G1341,BZIPT2 domain coordinates 1-34,288-398
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQTHIVQQLKYLNTIPSTEPTSELHRQSTLQLELEVQQWHHSFCNLVKAQRDYIQSLTGWLRLSLFQFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 139 - DNA, 1230 bp, Arabidopsis thaliana
  G1349,family:Z-LSDlike
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggaatggttcttatgaatgggaagaccatagatcagtcagagcttacaaaggaacagatggtggagcagctttctgtttcagtgcttgtgacgatgatgaatccagtggttacactcctgtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggagccactgctaacatcatctgaggaatttgacgtgtacgcgacaaagtttgtactctgaatgctgtacatatgatgctgcaaatagctcggaaacgtttctatgtgtatgtatcatgtaatgattatgttgcatagcctctctcttcttacgagcaataagctatgaaataattgattcgctaagaaatttaaaatgaaa

SEQ ID NO: 140 - protein, 362 aa, Arabidopsis thaliana
  G1349,Z-LSDlike domain coordinates 6-39
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 141 - DNA, 1001 bp, Arabidopsis thaliana
  G1352,family:Z-C2H2
gcgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattgaaa

SEQ ID NO: 142 - protein, 273 aa, Arabidopsis thaliana
  G1352,Z-C2H2 domain coordinates 108-129,167-188
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 143 - DNA, 1047 bp, Arabidopsis thaliana
  G1354,family:NAC
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 144 - protein, 348 aa, Arabidopsis thaliana
  G1354,NAC domain coordinates 7-157
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 145 - DNA, 1206 bp, Arabidopsis thaliana
  G1355,family:NAC
cgtcgacccgtcacatactcgatcaattataattatatattcggctgcgaagatttacaagaaataatggagccaatggaatcttgtagcgttcctccaggatttaggttccatccgacggacgaagagcttgtcgggtactatctaaggaagaaaatcgcatcgcaaaagattgatctcgacgtcatcagagacatcgatctctacagaatagaaccatgggatctacaagaacaatgtcgaatcggttatgaggaacaaaatgaatggtatttttttagtcacaaggacaagaaatatccaacggggacaagaactaatagagcgaccatggctggattttggaaagccacgggaagagacaaagctgtttacgacaaaacaaaactaattggtatgaggaaaacacttgtgttctacaaaggacgtgcacctaatggcaagaaatccgattggatcatgcatgagtaccggctcgagtcagatgagaatgcaccgccccaggaagaaggatgggtggtttgtagagcattcaaaaaaagagctacagggcaagccaagaacacggaaacttggagctcaagttacttttacgatgaagttgcaccgaatggagttaactcggttatggaccccattgattacatatctaagcagcaacataacatttttgggaaaggtttgatgtgtaagcaagaactagaaggaatggttgatggtataaactatatacaatcgaatcaattcattcagctcccacaactccaaagcccttctctcccgctgatgaaaagaccttcaagctcgatgtccataacatcaatggataacaattacaactataaactcccattagcggatgaagaaagcttcgagtcattcataagaggagaggatagaaggaagaagaaaaagcaagtaatgatgacgggaaattggagagagttagacaagtttgttgcttcacaacttatgagccaagaagacaatggaacttcaagtttcgcaggtcatcatatagttaatgaagataaaaacaacaatgatgtggagatggattcgtcaatgtttttgagcgaaagagaagaagaaaacaggttcgtcagtgaattcttgagtacaaactcggattatgatattgggatttgcgtatttgataattgaatgaaactacatagatggcatgtgagatttgttggtacgtgc

SEQ ID NO: 146 - protein, 365 aa, Arabidopsis thaliana
  G1355,NAC domain coordinates 9-159
MEPMESCSVPPGFRFHPTDEELVGYYLRKKIASQKIDLDVIRDIDLYRIEPWDLQEQCRIGYEEQNEWYFFSHKDKKYPTGTRTNRATMAGFWKATGRDKAVYDKTKLIGMRKTLVFYKGRAPNGKKSDWIMHEYRLESDENAPPQEEGWVVCRAFKKRATGQAKNTETWSSSYFYDEVAPNGVNSVMDPIDYISKQQHNIFGKGLMCKQELEGMVDGINYIQSNQFIQLPQLQSPSLPLMKRPSSSMSITSMDNNYNYKLPLADEESFESFIRGEDRRKKKKQVMMTGNWRELDKFVASQLMSQEDNGTSSFAGHHIVNEDKNNNDVEMDSSMFLSEREEENRFVSEFLSTNSDYDIGICVFDN

SEQ ID NO: 147 - DNA, 918 bp, Arabidopsis thaliana
  G1361,family:NAC
atgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaa

SEQ ID NO: 148 - protein, 305 aa, Arabidopsis thaliana
  G1361,NAC domain coordinates 59-200
MTWCNDRSDVQTVERIIPSPGAAESPVASLPVSCHKTCPSCGHNFKFHEQAGIHDLPGLPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHLGTSEEEKEGELVVSKVFYQTQPRQCGGSVAAAATAKDRPYLHGLGGGGGRHLHYHLHHNNGNGKSNGSGGTAGAGEYYHNIPAIISFNQTGIQNHLVHDSQPFIP

SEQ ID NO: 149 - DNA, 823 bp, Arabidopsis thaliana
  G1364,family:CAAT
ctcttctctcgatctctctccctctctgcctcctctcttcctccaatcaacaaacacctctctgtttcactcccgccctttttcgaattcttctgatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttc

SEQ ID NO: 150 - protein, 173 aa, Arabidopsis thaliana
  G1364,CAAT domain coordinates 29-118
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 151 - DNA, 1964 bp, Arabidopsis thaliana
  G1367,family:AT-hook
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttctt

SEQ ID NO: 152 - protein, 479 aa, Arabidopsis thaliana
  G1367,AT-hook domain coordinates 179-201,262-285,298-319,335-357
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 153 - DNA, 1294 bp, Arabidopsis thaliana
  G137,family:MADS
ccctcacacatttcttatcttttgctctcaatagattccattgattcaaaacaaaattttcattaagatttcacaacctccacacacttccaaacacaattaaagagaggaaaaagaatcaataaccctataaataaaaaatcagacaaacagaagtttcctcttcttcttccttaagctagtaccttttgttcttgaaattagggttaatttcttttttccaaataccatcaattctccagaccataaaaactcaaaaagatcagatctttcctctgaaaaagagatacccaacttatgtttttgtgtgtctgtatatagataaacattacatacccatatttgtgtatagacataaaaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggatgggaaggcggtgaacagaatgttacctacgcgcatcatcaagctcagtctcagggactataccagcctcttgaatgcaatccaactctgcaaatggggtatgataatccagtatgctctgagcaaatcactgcgacaacacaagctcaggcgcagccgggaaacggttacattccaggatggatgctctgagaatcatgtactgtgatgaagctcacccacaaaagaccttatatatatataaagtatagatacaagacttggatttgtagacataagtggctaatataatggtcctgaggatcttctagacatttgtatcttttgggaatccttgcttatattaagaattc

SEQ ID NO: 154 - protein, 248 aa, Arabidopsis thaliana
  G137,MADS domain coordinates 1-57
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 155 - DNA, 839 bp, Arabidopsis thaliana
  G1379,family:AP2
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 156 - protein, 184 aa, Arabidopsis thaliana
  G1379,AP2 domain coordinates 18-85
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 157 - DNA, 1337 bp, Arabidopsis thaliana
  G138,family:MADS
agaatggcttagcatctctgcaaaaccaacacaaagctatattctcttaaaaatcagttcaacaaaagaagaacctgaacacagttggcccaccaccaccactaccacaatctcctcctccaccaccaccacctagtcaccggaaaccaattcatgccctagattaagaaccagaatccttttgagacaagatctatatatacactctacacatttacttatacactttatctagatatagatgtgtgtgtgtataaaggttctttttcattacttgttggtttagtgataaaaaggaggagagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagcagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 158 - protein, 258 aa, Arabidopsis thaliana
  G138,MADS domain coordinates 1-57
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 159 - DNA, 2008 bp, Arabidopsis thaliana
  G1382,family:WRKY
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 160 - protein, 557 aa, Arabidopsis thaliana
  G1382,WRKY domain coordinates 210-266,385-437
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 161 - DNA, 979 bp, Arabidopsis thaliana
  G1384,family:AP2
ggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 162 - protein, 301 aa, Arabidopsis thaliana
  G1384,AP2 domain coordinates 127-194
MEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 163 - DNA, 1317 bp, Arabidopsis thaliana
  G1389,family:TEO
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaagacaaccatggaggttcaaattcatgatgacatgcattgaacaagaaggaggaaattaatgtgatgaatggagctagagtaagcgctatattaattagtattaccatctatccatatatttatgattcaagactattattactcatttagtgtttgttattattattcaattttgcttgtttgtttcttatcatctttgcattgatcatcaagattgtgatatttg

SEQ ID NO: 164 - protein, 361 aa, Arabidopsis thaliana
  G1389,TEO domain coordinates 30-87
MGLKGYSVGEGGGEIVEVQGGHIIRATGRKDRHSKVFTSKGPRDRRVRLSAHTAIQFYDVQDRLGYDRPSKAVDWLIKKAKTAIDKLELGETTTTTTRQEPVNTKPESPTLVFQRENNDQTQFVAANLDPEDAMKTFFPATTTTNGGGGTNINFQNYPHQDDNNMVSRTTTPPPNLSQDLGLSLHPFQGNNNTVVVPETNNFTTTHFDTFGRISGWNHHDLTMTSSSSSEHQQQEQEERSNGGFMVNHHPHHHHHQPSMMTLLNSQQQQVFLGGQQQQQQRGTLQSSLFPHSFRSWDHHQTTSDHHHHQNQASSMFASSSQYGSHGMMMMQGLSFPNTTRLLHGEEATQPNSSSSPPNSHL

SEQ ID NO: 165 - DNA, 1348 bp, Arabidopsis thaliana
  G139,family:MADS
gattcacaaaaacttttcttcagattcacaatctcatcacaacccttcaaaaagagaaaagatctaaagaataaacaagagccctaatatcaaatcacaaccaaaaaaaccaaagaaagctaattaaagttttctctctagctattcctcttcttttcttgttcttgaaaactagggtttacttcaccaaaagataagatctttccccagaaaaagcaatacccaagtcatgtttctgtgtgtctgtatatagataaaacattacataccctaataaggttacacaaatagctataaaagagggaaaataagatagggattttttggggtgaggaaagatgggaagaggaagagtagagctcaagaggatagagaacaaaatcaacagacaagtgacgtttgctaaacgtagaaatggtttgctgaaaaaagcttatgagctttctgttctctgcgatgctgaagtctctctcatcgtcttctccaaccgtggcaagctctacgagttctgcagcacctccaacatgctcaagacactggaaaggtatcagaagtgtagctatggctccattgaagtcaacaacaaacctgctaaagagcttgagaacagctacagagagtacttgaagctgaaaggtagatatgaaaatctgcaacgtcagcagagaaatcttcttggagaggatcttggacctctgaattcaaaggagctagagcagcttgagcgtcaactagacggctctctgaagcaagttcgctgcatcaagacacagtatatgcttgaccagctctctgatcttcaaggtaaggagcatatcttgcttgatgccaacagagctttgtcaatgaagctggaagatatgatcggcgtgagacatcaccatataggaggaggatgggaaggtggtgatcaacagaatattgcctatggacatcctcaggctcattctcagggactataccaatctcttgaatgtgatcccactttgcaaattggatatagccatccagtgtgctcagagcaaatggctgtgacggtgcaaggtcagtcccaacaaggaaacggctacatccctggctggatgctgtgagcgatacttcttcccccaataaagatcttaagcaagtactggtggggtcttcgtggtgtgatcttagatcttatgcatatgaataataatgttattgcacaagacttttgcttttgtagacacaagtggctatagctgtaatagccttcaacatctctcttctgtttcaggatttgtttgtgcctattgtaattgcttatatatgtatggtttgtataatgtgtgaaatgttaacatcgaccatgtctcatctggtg

SEQ ID NO: 166 - protein, 250 aa, Arabidopsis thaliana
  G139,MADS domain coordinates 1-57
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGGWEGGDQQNIAYGHPQAHSQGLYQSLECDPTLQIGYSHPVCSEQMAVTVQGQSQQGNGYIPGWML

SEQ ID NO: 167 - DNA, 462 bp, Arabidopsis thaliana
  G1394,family:S1FA
gtcctaagtatacatgtcttttttgtcttttgtctgaatctttctcgtcggaaacacagatctcagttccttacagaagaatctccgactcgtttctttgccggcattctcagatttccggatactagccatgagcagtgatggttccgccggaaaggcggttgttgaagccaaaggattgaaccctggattgatagtgctgcttgttattggaggtctgcttgtgacatttctcatagccaattacgttatgtacatgtatgctcagaagaatctacctccaaggaagaagaagcctctttccaaaaagaagctcaagcgtgagaagctgaagcagggagtccctgtgcccggcgaatagattccagcttcttcaacagtctgtgtttttaacctgtaatcacaatgtcattgagacttttgtatgggagagtagcaaacgtcccttgttctggaaaaaaa

SEQ ID NO: 168 - protein, 76 aa, Arabidopsis thaliana
  G1394,S1FA domain coordinates 13-63
MSSDGSAGKAVVEAKGLNPGLIVLLVIGGLLVTFLIANYVMYMYAQKNLPPRKKKPLSKKKLKREKLKQGVPVPGE

SEQ ID NO: 169 - DNA, 435 bp, Arabidopsis thaliana
  G1395,family:S1FA
attttttccggcgagcggtgctgataacctcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactcattagttttttgatgttttcgatgtagcatgcatgatattttcttgagttgacaatctataagctttactgagataaaaaaaaa

SEQ ID NO: 170 - protein, 73 aa, Arabidopsis thaliana
  G1395,S1FA domain coordinates 1-72
MAAEFDGKIESKGLNPGLIVLLVIGGLLLTFLVGNFILYTYAQKNLPPRKKKPVSKKKMKKEKMKQGVQVPGE

SEQ ID NO: 171 - DNA, 963 bp, Arabidopsis thaliana
  G140,family:MADS
gaattcatcttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatctatagtgtcacctaaatgcggccgcgtccctcaacatctagtcgcaagctgaggggaaccactagtgtcatacgaacctccaagagacggttacacaaacggg

SEQ ID NO: 172 - protein, 246 aa, Arabidopsis thaliana
  G140,MADS domain coordinates 16-72
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 173 - DNA, 249 bp, Arabidopsis thaliana
  G1403,family:GF14
atgtgttgttactttgccactaggattgtttacggcctgcaaccggaggctctgatgatgttggatgcattgggtgatgaattatacaaggacagtaccctgattatgaagattcttagagacaatctcactttctggacttcagatatgactgacgaagcaggagatgagatcaaggaggcagaaccaaaggtcttgtgcaaatgtcattcttgtttcactgtcttgtcggaaccaaagcatagttaa

SEQ ID NO: 174 - protein, 82 aa, Arabidopsis thaliana
  G1403,GF14 domain coordinates 16-61
MCCYFATRIVYGLQPEALMMLDALGDELYKDSTLIMKILRDNLTFWTSDMTDEAGDEIKEAEPKVLCKCHSCFTVLSEPKHS

SEQ ID NO: 175 - DNA, 1053 bp, Arabidopsis thaliana
  G1410,family:HS
atggcgttgttctccccgccaatctcttcttcatctcttcaaaatcccaatttcattcccaaattttcattctccctcctctccagtaaccgcttctctctcctctccgtcactcgagcttcctccgacagtggatcaacctctcccaccgccgccgtctccgtggaggctcctgagcccgtggaagtgatagttaaagagcctccgcaatcaacaccggcggttaaaaaggaagaaaccgccaccgctaaaaatgtcgccgtcgaaggtgaagagatgaaaacaacggagagtgttgtcaaattccaggatgcgagatggattaatggaacttgggatctgaaacagttcgagaaagatggaaaaaccgattgggattctgtaatcgttgctgaggcaaagagaagaaaatggctagaagagaatccagaaacaacgagtaacgacgaaccagtgcttttcgatacatcgattattccatggtgggcttggattaagagataccacttacctgaagctgaactcttaaatggtcgtgcggcgatgataggattctttatggcttactttgtcgatagtcttaccggagtaggacttgttgatcaaatggggaatttcttctgcaagacactattgtttgtggctgtggctggagttttgtttattcgtaagaatgaggatgtggataaactcaagaacttgtttgatgagactacattgtatgataagcaatggcaagcagcttggaaaaatgatgatgatgagtcattgggttctaagaagaagttgcttgaccgatacgggtttaggaaacttgactctgagcaaagggaatttgctgatggtgactttgtgagaggtaaacctgagcttatccggaacatatataaacgcaccagagctcaaatactaaacactaaagaagggagagagctgcttaagcaagtcatggagatgaggaaacagaggagagaaaagatgaagaaagagattacgaaagcaaaggaactagctgatcggttgcaccatgtacatatttggaacatacaatga

SEQ ID NO: 176 - protein, 350 aa, Arabidopsis thaliana
  G1410,HS domain coordinates 206-298
MALFSPPISSSSLQNPNFIPKFSFSLLSSNRFSLLSVTRASSDSGSTSPTAAVSVEAPEPVEVIVKEPPQSTPAVKKEETATAKNVAVEGEEMKTTESVVKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKKLLDRYGFRKLDSEQREFADGDFVRGKPELIRNIYKRTRAQILNTKEGRELLKQVMEMRKQRREKMKKEITKAKELADRLHHVHIWNIQ

SEQ ID NO: 177 - DNA, 820 bp, Arabidopsis thaliana
  G1419,family:AP2
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 178 - protein, 221 aa, Arabidopsis thaliana
  G1419,AP2 domain coordinates 69-137
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 179 - DNA, 1260 bp, Arabidopsis thaliana
  G1421,family:AP2
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 180 - protein, 287 aa, Arabidopsis thaliana
  G1421,AP2 domain coordinates 84-146
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 181 - DNA, 1005 bp, Arabidopsis thaliana
  G1423,family:MADS
atggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttga

SEQ ID NO: 182 - protein, 334 aa, Arabidopsis thaliana
  G1423,MADS domain coordinates 6-62
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 183 - DNA, 1281 bp, Arabidopsis thaliana
  G1435,family:GARP
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 184 - protein, 298 aa, Arabidopsis thaliana
  G1435,GARP domain coordinates 146-194
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 185 - DNA, 1470 bp, Arabidopsis thaliana
  G1437,family:GRF-like
aatctctctccctctctctctatatatgttacattagtatgatatgaaagtaaaggcaagcaacgttttactcattatcttctcaccaaatttatagcccacaacggatcttttactttctttcttttgaaataagtcacatgttcttcagtctcttctcatgataatataaagggcaaaagaaaaatctcacaatctttacaagagtttttaaaatctctaaccttcatggactttctcaaagtttcagacaagacaacaattccatatagaagtgattctttgtttagtttgaatcagcaacaatacaaagagtcttcttttggattcagagacatggagattcatccgcatcctactccatatgcaggaaatggacttttgggttgttattactattaccctttcacaaacgcacaattgaaggagcttgagagacaagcaatgatctacaagtacaagatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttaggagttatggagtttggtaataacgactttttgtttgagttttggcctttcttcaatcttgtgcctgtaaactagtactgtaaacagtcactttgattaattatggagttatattatcaatgcttgtttagtttttaaaaaaaaa

SEQ ID NO: 186 - protein, 365 aa, Arabidopsis thaliana
  G1437,GRF-like domain coordinates 59-150
MDFLKVSDKTTIPYRSDSLFSLNQQQYKESSFGFRDMEIHPHPTPYAGNGLLGCYYYYPFTNAQLKELERQAMIYKYKIASIPVPFDLLVSSPSSASPCNNKNIAGDLEPGRCRRTDGKKWRCAKEVVSNHKYCEKHLHRGRPRSRKHVEPPYSRPNNNGGSVKNRDLKKLPQKLSSSSIKDKTLEPMEVSSSISNYRDSRGSEKFTVLATTEQENKYLNFIDVWSDGVRSSEKQSTTSTPVSSSNGNLSLYSLDLSMGGNNLMGQDEMGLIQMGLGVIGSGSEDHHGYGPYGVTSSLEEMSSWLAPMSTTPGGPLAEILRPSTNLAISGDIESYSLMETPTPSSSPSRVMKKMTSSVSDESSQV

SEQ ID NO: 187 - DNA, 1517 bp, Arabidopsis thaliana
  G1438,family:GRF-like
tatcaaaccagaggaaaagagtgacagagaaagtggtcatctttgtctgtctctgtccgaaactcaggagccctaatctctgaatccatcaagaaagctctttctcttccttcttttatgcttctgaatttgctacatatataaactatctgaagaaagctagagaataagatgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggtactttcaagggattggggagagagttggaggagttggggagagaacgttctttccagaagcatctagaagctttcaagattctccataccatcatcaccaacaaccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtaattaattaagtagagctggcatcaatgatggatctgcaccaacacacacaactgtgaaatggtgaagaagagtcacatttcacatctatttccgtggaacaatgagacaagacactgtttgcagaatcctatatgtattttttctatctttttctat

SEQ ID NO: 188 - protein, 397 aa, Arabidopsis thaliana
  G1438,GRF-like domain coordinates 16-124
MMSLSGSSGRTIGRPPFTPTQWEELEHQALIYKYMVSGVPVPPELIFSIRRSLDTSLVSRLLPHQSLGWGCYQMGFGRKPDPEPGRCRRTDGKKWRCSREAYPDSKYCEKHMHRGRNRARKSLDQNQTTTTPLTSPSLSFTNNNNPSPTLSSSSSSNSSSTTYSASSSSMDAYSNSNRFGLGGSSSNTRGYFNSHSLDYPYPSTSPKQQQQTLHHASALSLHQNTNSTSQFNVLASATDHKDFRYFQGIGERVGGVGERTFFPEASRSFQDSPYHHHQQPLATVMNDPYHHCSTDHNKIDHHHTYSSSSSSQHLHHDHDHRQQQCFVLGADMFNKPTRSVLANSSRQDQNQEEDEKDSSESSKKSLHHFFGEDWAQNKNSSDSWLDLSSHSRLDTGN

SEQ ID NO: 189 - DNA, 1654 bp, Arabidopsis thaliana
  G1439,family:GRF-like
ctctgaagtgattatttagcactactttttctttgtctccttctgaatccattttttatggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtgaaact

SEQ ID NO: 190 - protein, 530 aa, Arabidopsis thaliana
  G1439,GRF-like domain coordinates 133-239
MDLGVRVSGHETVSSPGQTELGSGFSNKQERSGFDGEDCWRSSKLSRTSTDGFSSSPASAKTLSFHQGIPLLRSTTINDPRKGQEHMLSFSSASGKSDVSPYLQYCRNSGYGLGGMMNTSNMHGNLLTGVKGPFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVEGQNGHNTNAAAAASAAAASTAAAVSKAAAGTSAVAMRGSDNNNSLAAAVGTQHHTNNQSTDSLANRVQNSRGASVFPATMNLQSKETHPKQSNNPFEFGLISSDSLLNPSHKQASYATSSKGFGSYLDFGNQAKHAGNHNNVDSWPEELKSDWTQLSMSIPMAPSSPVQDKLALSPLRLSREFDPAIHMGLGVNTEFLDPGKKTNNWIPISWGNNNSMGGPLGEVLNSTTNSPKFGSSPTGVLQKSTFGSLSNSSSASSTIIGDNNNKNGDGKDPLGPTTLMNTSATAPSL

SEQ ID NO: 191 - DNA, 1293 bp, Arabidopsis thaliana
  G1442,family:GRF-like
atgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatgtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaa

SEQ ID NO: 192 - protein, 430 aa, Arabidopsis thaliana
  G1442,GRF-like domain coordinates 111-223
MGTRAERKEDFVGGFGFGVVENSHKDVMVLPHHHYYPSYSSPSSSSLCYCSAGVSDPMFSVSSNQAYTSSHSGMFTPAGSGSAAVTVADPFFSLSSSGEMRRSMNEDAGAAFSEAQWHELERQRNIYKYMMASVPVPPELLTPFPKNHQSNTNPDVTVAVATGGSLQLGIASSASNNTADLEPWRCKRTDGKKWRCSRNVIPDQKYCERHTHKSRPRSRKHVESSHQSSHHNDIRTAKNDTSQLVRTYPQFYGQPISQIPVLSTLPSASSPYDHHRGLRWFTKEDDAIGTLNPETQEAVQLKVGSSRELKRGFDYDLNFRQKEPIVDQSFGALQGLLSLNQTPQHNQETRQFVVEGKQDEAMGSSLTLSMAGGGMEETEGTNQHQWVSHEGPSWLYSTTPGGPLAEALCLGVSNNPSSSTTTSSCSRSSS

SEQ ID NO: 193 - DNA, 1462 bp, Arabidopsis thaliana
  G1443,family:GRF-like
cgaggtgggtttttgcttctctgtgtcgctagtttcaaaagctgtctcctttttcttggaattgaataaagcttccccaaaaatccaatttttgttatgaagatgcagagccctaaaatggagcaggaggaggttgaggaggagaggatgaggaataagtggccgtggatgaaggcggcgcagttaatggagtttcggatgcaagctttggtgtatagatacatagaggctggtctccgtgtgcctcatcatctcgtggtgcctatttggaacagtcttgctctctcttcttcctccaattacaactatcactcttcttctctgttgagtaacaagggagtaacccatatcgacacgttggaaactgaaccaactaggtgcaggagaacagatgggaagaaatggcgctgtagcaacacggtccttctattcgagaagtactgtgaacggcacatgcatagaggtcgtaaacgttcaagaaagcttgtggaatcttcttctgaggttgcttcatcatcaaccaaatacgacaacacttatggtttggataggtataacgagagtcagagtcatcttcatgggacaatctcgggttctagtaatgcgcaggtagttaccattgcttcactgcctagtgccagatcctgtgaaaatgtcattcgtccgtctttagtgatctctgaattcacaaacaaaagtgtgagtcacggcagaaagaacatggagatgagttatgatgactttattaatgaaaaagaggcgagtatgtgtgttggagttgttcctcttcaaggtgatgagagcaaaccttcggttcaaaagttcttccctgaggtatctgataaatgcttagaagctgcaaaattctcaagcaacaggaagaatgatataattgcaagaagcagagaatggaagaatatgaatgttaatggtggtttgtttcatggtatccacttttctccagacactgttcttcaagaacgtggttgttttcgtttacaaggagttgaaacagacaatgaaccaggaaggtgccgaagaacagatgggaagaagtggagatgcagcaaagatgttttgtctggtcagaagtactgcgataagcacatgcatagaggtatgaagaagaagcatccagttgatactactaactcacatgagaatgccgggtttagcccgttaaccgtggaaacagctgttagatcggttgtgccttgcaaagatggagatgaccagaagcattctgtttcagtcatgggaattacactgccccgagtttctgatgagaagagcactagcagttgcagtaccgacactaccattactgacacagctttaaggggtgaagacgacgatgaggagtacttgtctttgttttcaccaggtgtttagaaacatagaaatgttgtcgaggttcaaatgatgtttttagtttcaatctaaggatctttctgtgttagat

SEQ ID NO: 194 - protein, 431 aa, Arabidopsis thaliana
  G1443,GRF-like domain coordinates 24-132
MKMQSPKMEQEEVEEERMRNKWPWMKAAQLMEFRMQALVYRYIEAGLRVPHHLVVPIWNSLALSSSSNYNYHSSSLLSNKGVTHIDTLETEPTRCRRTDGKKWRCSNTVLLFEKYCERHMHRGRKRSRKLVESSSEVASSSTKYDNTYGLDRYNESQSHLHGTISGSSNAQVVTIASLPSARSCENVIRPSLVISEFTNKSVSHGRKNMEMSYDDFINEKEASMCVGVVPLQGDESKPSVQKFFPEVSDKCLEAAKFSSNRKNDIIARSREWKNMNVNGGLFHGIHFSPDTVLQERGCFRLQGVETDNEPGRCRRTDGKKWRCSKDVLSGQKYCDKHMHRGMKKKHPVDTTNSHENAGFSPLTVETAVRSVVPCKDGDDQKHSVSVMGITLPRVSDEKSTSSCSTDTTITDTALRGEDDDEEYLSLFSPGV

SEQ ID NO: 195 - DNA, 906 bp, Arabidopsis thaliana
  G145,family:MADS
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacaaagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcagcaagatggaatgggagcaggaccaagtgtgaataattacatgttgggttggttaccttatgacaccaactctatttgaatctttctcacttaattaatctctcttttttttgacatttttaagatgatgtttctattttattacctctctcacgttttctgtcttgtgtgcatgtgtctgtgtaatgtttattgcccttctattattcaatgatttctcgac

SEQ ID NO: 196 - protein, 251 aa, Arabidopsis thaliana
  G145,MADS domain coordinates 1-57
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 197 - DNA, 2816 bp, Arabidopsis thaliana
  G1451,family:ARF
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 198 - protein, 811 aa, Arabidopsis thaliana
  G1451,ARF domain coordinates 22-357
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 199 - DNA, 1848 bp, Arabidopsis thaliana
  G1456,family:NAC
tttttttttgtgataacgagagagaaaaaagtgatggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctgagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtgagaaccgaaaaatccaagaggttaagagacataaaggcttggttttgtgtgaaccattagagagtcaagtcattgtaattattctcttggattattagattcagaagctgtttagtatcacagtttatgcttggaagttttctctggtattggtaaaaaagtaccaatagaaataagcaaaagaattttcttatcttttaaaaaaaaaaaaaaaaaaaaaaaaaaaaaa

SEQ ID NO: 200 - protein, 528 aa, Arabidopsis thaliana
  G1456,NAC domain coordinates NA
MDLSVENGGLAPGFRFHPTDEELVVYYLKRKIRRKKLRVEAIGETDVYKFDPEELPEKALYKTRDRQWFFFSLRDRKHGSRSSRATERGYWKATGKDRVIHCDSRPVGEKKTLVFHRGRAPNGERTNWVMHEYTLHKEELKRCGGEDVKDAYVLYKIYKKSGSGPKNGEQYGAPFIEEEWAEDDDDDVDEPANQLVVSASVDNSLWGKGLNQSELDDNDIEELMSQVRDQSGPTLQQNGVSGLNSHVDTYNLENLEEDMYLEINDLMEPEPEPTSVEVMENNWNEDGSGLLNDDDFVGADSYFLDLGVTNPQLDFVSGDLKNGFAQSLQVNTSLMTYQANNNQFQQQSGKNQASNWPLRNSYTRQINNGSSWVQELNNDGLTVTRFGEAPGTGDSSEFLNPVPSGISTTNEDDPSKDESSKFASSVWTFLESIPAKPAYASENPFVKLNLVRMSTSGGRFRFTSKSTGNNVVVMDSDSAVKRNKSGGNNDKKKKKNKGFFCLSIIGALCALFWVIIGTMGGSGRPLLW

SEQ ID NO: 201 - DNA, 905 bp, Arabidopsis thaliana
  G146,family:MADS
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 202 - protein, 230 aa, Arabidopsis thaliana
  G146,MADS domain coordinates 1-57
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 203 - DNA, 1034 bp, Arabidopsis thaliana
  misc_feature (1029)..(1029): n is a, c, g, or t
  G1460,family:NAC
cgtcgaccttcactcaaaccctaatcccgggaacccgggaattttgatcattttgtttcttttcgatctgtttctattttaaaaagatgatgaaagatccgactgggtatagatttagtccgacgggagaggaagtgataaaccattacctaaagaacaaaattctgggtaagacttggctcgttgatgaagccattagcgagatcaacatcttgaatcacaaacccagcaaggatttgcctaagttagctaggatccaatcggaagatcttgagtggtactttttctctccgattgagtacacgaacccgaataagatgaaaatgaagaggacgacaggttctgggttttggaaacctagtggtgttgatcggaaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaacggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgagacatgttgatcgagagccggttgaatatttgtttgccaatgaagaaaacatggatggtttgtctattatgaatgacttgacaatcccaatgatcgcccaacaagaggatctcattctctctgagtgggagggatttatcgcagccacctttttcagcgacaacaacaataacaataaccttaacgtgcatcaactaacgtctttcttaccgggatgattatcagaatgcattttgggttacaacggagcgnccgct

SEQ ID NO: 204 - protein, 302 aa, Arabidopsis thaliana
  G1460,NAC domain coordinates NA
MMKDPTGYRFSPTGEEVINHYLKNKILGKTWLVDEAISEINILNHKPSKDLPKLARIQSEDLEWYFFSPIEYTNPNKMKMKRTTGSGFWKPSGVDRKIRDKRGNGVVIGIKKTLVYHEGKSPHGVRTPWVMHEYHITCLPHHKRKYVVCQVKYKGEAAEISYEPSPSLVSDSHTVIAINGEPEPELQVEQPGKENLLGMSVDDLIEPMNQQEEPQGPHLAPNDDEFIRGLRHVDREPVEYLFANEENMDGLSIMNDLTIPMIAQQEDLILSEWEGFIAATFFSDNNNNNNLNVHQLTSFLPG

SEQ ID NO: 205 - DNA, 1092 bp, Arabidopsis thaliana
  G1462,family:NAC
cattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctatag

SEQ ID NO: 206 - protein, 322 aa, Arabidopsis thaliana
  G1462,NAC domain coordinates 14-273
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 207 - DNA, 915 bp, Arabidopsis thaliana
  G1469,family:Z-C2H2
atgtattcacttctcaagaaaacaaaaatctgtcaggtgtgcaagaaatcattttcaaacgggaaagctcttggtggtcacatgagagctcacactttgaaatttttccctggatcatcttcatcaactggctcgatcactccatcactacgatcatgcaacaaccttggagcaagctttagaagacctaatgaaacagttctggcgagatttgtccacaccagtgaagttgttggtggtccaaagccagatctaaacaaagaagctgagcaacgaacaactgtcaagaaaaagatcgtcgtggatttggaagaggaaaattcgatagagtctgaaagcgatataactattgaagaaagtgctttatgtcttttacaaatgaaggatgacaacatgtcagaatatcttcagaatctgaaatcgattgatagtttggtatcaactcgaaaaagaaaagatactgaaaactatatcgaaatagattctgatgaaaatcacgaagatagtgatgatgagtacgttgttgaagatgaagatgaagacaatgaagatgacgatgttaagtctctcacttcagatgtggaaaacctaataggagacagcgatgaagatgatgatgattatggtgatgaaaacgcatattacggtggaaaaaggaaaaggggtaagaaacaaagtaaatatacgtgtgatacttgtggaaaagttttacgttcgtatcaggcattaggtggtcatcgaacgagccacaaatacaagcgattgaagatttccgacaagaattatttcggggaagatgggccaatagttcgacgacaatacgagtgtcaaatttgtaacagaatgtttgcatctggtcaagcacttggtggtcacaaaaagattcactatatgttcctagctccagccaagtaa

SEQ ID NO: 208 - protein, 304 aa, Arabidopsis thaliana
  G1469,Z-C2H2 domain coordinates 11-31,230-250,276-296
MYSLLKKTKICQVCKKSFSNGKALGGHMRAHTLKFFPGSSSSTGSITPSLRSCNNLGASFRRPNETVLARFVHTSEVVGGPKPDLNKEAEQRTTVKKKIVVDLEEENSIESESDITIEESALCLLQMKDDNMSEYLQNLKSIDSLVSTRKRKDTENYIEIDSDENHEDSDDEYVVEDEDEDNEDDDVKSLTSDVENLIGDSDEDDDDYGDENAYYGGKRKRGKKQSKYTCDTCGKVLRSYQALGGHRTSHKYKRLKISDKNYFGEDGPIVRRQYECQICNRMFASGQALGGHKKIHYMFLAPAK

SEQ ID NO: 209 - DNA, 735 bp, Arabidopsis thaliana
  G1471,family:Z-C2H2
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 210 - protein, 244 aa, Arabidopsis thaliana
  G1471,Z-C2H2 domain coordinates 49-70
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 211 - DNA, 944 bp, Arabidopsis thaliana
  G1474,family:Z-C2H2
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccga

SEQ ID NO: 212 - protein, 304 aa, Arabidopsis thaliana
  G1474,Z-C2H2 domain coordinates 41-68
MEKPGGFWIPKKSNKESSWEELAFAEDDAAGSLWPPRSYTCSFCRREFKSAQALGGHMNVHRRDRARLKQADDQYLFPKSSSSPEYPSHKDSDNIHETSCYTLVFNTKPNYFKTQHSCVIDLSSSSSLPYLTPSRVSSGLPGKQHTSSSPPSFVVEPSKNSKYIPSSSPWSCPSTVVEQKSCDLYEIPAMEGEKKRKTESDVPKIGHKAKLSLGNTTDLSVSMNLVIHQSFPITAHGSDEEIGRVDIRKRRRRHESPSQQSIFISSLSCKSDIITRNEESKHKGDRFEDLDLELRLGTDPPKGI

SEQ ID NO: 213 - DNA, 354 bp, Arabidopsis thaliana
  G1478,family:Z-CO-like
atgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctga

SEQ ID NO: 214 - protein, 117 aa, Arabidopsis thaliana
  G1478,Z-CO-like domain coordinates 32-76
MCRGFEKEEERRSDNGGCQRLCTESHKAPVSCELCGENATVYCEADAAFLCRKCDRWVHSANFLARRHLRRVICTTCRKLTRRCLVGDNFNVVLPEIRMIARIEEHSSDHKIPFVFL

SEQ ID NO: 215 - DNA, 914 bp, Arabidopsis thaliana
  G148,family:MADS
aaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcggagttggcagaaccattgagaggtactatcgctgtaaagacaatcttttggacaatgatacgcttgaagatactcagggcttgcgtcaagaggtgacaaagctcaaatgcaaatacgaatctcttcttcgcactcataggaatttggttggggaagatcttgaagggatgagtataaaggaattgcagacgctggagagacagcttgaaggagctctttccgcaacccgaaaacaaaagacgcaggttatgatggaacaaatggaagagcttcggagaaaggagagggagctcggagatataaacaataagctaaagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcgtttaggtcatttactatcgggacatactcttttttttttttttttctttttttttttcacaagacatactcttttctttaatttcaattatttgttagagttctcgtt

SEQ ID NO: 216 - protein, 244 aa, Arabidopsis thaliana
  G148,MADS domain coordinates 1-57
MGRGKVEVKRIENKITRQVTFSKRKSGLLKKAYELSVLCDAEVSLIIFSTGGKLYEFSNVGVGRTIERYYRCKDNLLDNDTLEDTQGLRQEVTKLKCKYESLLRTHRNLVGEDLEGMSIKELQTLERQLEGALSATRKQKTQVMMEQMEELRRKERELGDINNKLKLETEDHDFKGFQDLLLNPVLTAGCSTDFSLQSTHQNYISDCNLGYFLQIGFQQHYEQGEGSSVTKSNARSDAETNFVQ

SEQ ID NO: 217 - DNA, 1221 bp, Arabidopsis thaliana
  G1480,family:Z-CO-like
atggaccccacatggatagactcattgacacgctcatgtgaagccaatagtaacaccaaccacaaaagaaagagagagagagagacactgaaacatagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttaggattccgacggtgaacgagaattgctttgaaatggattttaccggaggatctaaaggctttacttatggtggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactataaggtatgcttcaaggaaagcgtatgcggaaatgagaccgagaatcaagggacggtttgcgaagcggacggatacaaatgagagcaatgatgtggttggtcatggtggtatctttagtgggttcggacttgtacctacattttag

SEQ ID NO: 218 - protein, 406 aa, Arabidopsis thaliana
  G1480,Z-CO-like domain coordinates 50-73,92-116
MDPTWIDSLTRSCEANSNTNHKRKRERETLKHREKKKKRFRERKMASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 219 - DNA, 1020 bp, Arabidopsis thaliana
  G1487,family:GATA/Zn
atggaacaagccgcgttgaagagcagcgtcaggaaagagatggctctcaaaacgacttctccggtttacgaagagtttcttgccgtcaccaccgctcaaaatggcttttccgtcgacgatttctctgtagacgacttgcttgacttgtcaaacgatgacgtttttgccgacgaagaaactgacctcaaggctcaacatgagatggtccgtgtttcctctgaggaacccaacgacgacggagacgctcttcgccggagcagcgatttctccggctgtgacgactttggttctctccctacaagcgaactctctcttccggcggatgatttagcgaaccttgagtggctctctcatttcgtggaggactccttcacggaatattcgggtccaaacctcaccggaaccccgactgagaaaccggcgtggttaacgggtgaccggaaacatcctgtgactgcagtcacggaagagacctgtttcaaatcccctgttccggctaaagcccgtagcaaacgtaaccgcaatggcctcaaggtctggtcgcttggttcgtcgtcctcctcgggtccttcctcgtccggttcgacctcctcctcctcttcgggtccttccagcccgtggttctccggcgctgagctgctcgagcctgtggtcacgtcagagaggccaccgtttcccaagaagcataagaaaaggtcagccgagtctgttttctccggtgagctgcagcagctgcaacctcagcgaaagtgcagccactgcggcgttcagaaaactccgcagtggagagccgggccaatgggagccaagaccctgtgcaatgcgtgcggtgtccggtacaagtcgggtaggttgctaccggaatacagacccgcttgtagcccgacattctcgagtgagctgcactcgaaccaccaccggaaagtcatagagatgaggcggaagaaggagccaaccagtgacaacgaaaccggtttaaaccagctggttcagtccccacaagctgtaccaagtttttga

SEQ ID NO: 220 - protein, 339 aa, Arabidopsis thaliana
  G1487,GATA/Zn domain coordinates 251-276
MEQAALKSSVRKEMALKTTSPVYEEFLAVTTAQNGFSVDDFSVDDLLDLSNDDVFADEETDLKAQHEMVRVSSEEPNDDGDALRRSSDFSGCDDFGSLPTSELSLPADDLANLEWLSHFVEDSFTEYSGPNLTGTPTEKPAWLTGDRKHPVTAVTEETCFKSPVPAKARSKRNRNGLKVWSLGSSSSSGPSSSGSTSSSSSGPSSPWFSGAELLEPVVTSERPPFPKKHKKRSAESVFSGELQQLQPQRKCSHCGVQKTPQWRAGPMGAKTLCNACGVRYKSGRLLPEYRPACSPTFSSELHSNHHRKVIEMRRKKEPTSDNETGLNQLVQSPQAVPSF

SEQ ID NO: 221 - DNA, 996 bp, Arabidopsis thaliana
  G1488,family:GATA/Zn
atggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttga

SEQ ID NO: 222 - protein, 331 aa, Arabidopsis thaliana
  G1488,GATA/Zn domain coordinates 221-246
MEDEAHEFFHTSDFAVDDLLVDFSNDDDEENDVVADSTTTTTITDSSNFSAADLPSFHGDVQDGTSFSGDLCIPSDDLADELEWLSNIVDESLSPEDVHKLELISGFKSRPDPKSDTGSPENPNSSSPIFTTDVSVPAKARSKRSRAAACNWASRGLLKETFYDSPFTGETILSSQQHLSPPTSPPLLMAPLGKKQAVDGGHRRKKDVSSPESGGAEERRCLHCATDKTPQWRTGPMGPKTLCNACGVRYKSGRLVPEYRPAASPTFVLAKHSNSHRKVMELRRQKEMSRAHHEFIHHHHGTDTAMIFDVSSDGDDYLIHHNVGPDFRQLI

SEQ ID NO: 223 - DNA, 1342 bp, Arabidopsis thaliana
  G1491,family:GARP
cgtcgactatctctgaactgagagtagcaggttgcaattaaaaactaaagattgtgtcagacttatgtattaccacaaccagcaccaaggaaagagcatcctctcttcatcgagaatgcccatttcttctgaaaggcatccgttcctcagaggaaatggcacaggagattctggactcattctctccactgatgcaaagccacgactaaaatggactccagatcttcacgagagatttgttgaagcggtcaaccagcttggaggaggagataaggctactcctaagacaatcatgaaagtcatgggcattccaggccttaccttataccatctcaagagtcatcttcagaaatataggctaagcaagaatcttaatggacaagctaacagcagtttaaacaagacaagtgtgatgaccatggtagaagaaaacccccctgaagtagacgaaagtcacagtgagagtttaagcattggaccacagccgagcatgaacttacccataagtgatgcccttcaaatgcaaatagaggtccagagacggctacacgagcaacttgagctcaggatagaggctcaaggaaagtacctgcaatcgattctggagaaagcacaagagactcttggaagacagaacctaggtgcagctgggattgaagcaacaaaagctcaactctcagaattagtatctaaagtatcagcagactatccagactctagtttcctcgaaccgaaagaactgcagaatctacaccatcaacagatgcaaaaaacgtatccacctaactcctccctggacagttgcctaacctcaagtgaaggaactcagaaagccccaaagatgcttgacaacagactgggattaagaacatatattggagattcaacttcagagcagaaagagataatggaagagccattcttccatagaatggagctcacatgggcagaagaagaaagcctcagagagaatcacaacaggccatatctttcaacaatggttaacaacgcagaaccgagaatctcgtcttcaagaagaagtcctggaagattgtcaataggagtgggattacatgaacacagaggaaggagtagcaacaacagtgagtatacagaagaaagattcaacgagaataatgaagattgcaagcttgaaacacacacaagaacagctctagatcttaacacacacgacgaaaactatggcacaacgcgtcctaaacagtttgatttaaatggtttcagctggaattgagaagaacaaataagctttagaagagtgcaacaacctttttatgataatcacacaggaaatgaaaagcctttcatttccgcggccgct

SEQ ID NO: 224 - protein, 396 aa, Arabidopsis thaliana
  G1491,GARP domain coordinates 50-100
MYYHNQHQGKSILSSSRMPISSERHPFLRGNGTGDSGLILSTDAKPRLKWTPDLHERFVEAVNQLGGGDKATPKTIMKVMGIPGLTLYHLKSHLQKYRLSKNLNGQANSSLNKTSVMTMVEENPPEVDESHSESLSIGPQPSMNLPISDALQMQIEVQRRLHEQLELRIEAQGKYLQSILEKAQETLGRQNLGAAGIEATKAQLSELVSKVSADYPDSSFLEPKELQNLHHQQMQKTYPPNSSLDSCLTSSEGTQKAPKMLDNRLGLRTYIGDSTSEQKEIMEEPFFHRMELTWAEEESLRENHNRPYLSTMVNNAEPRISSSRRSPGRLSIGVGLHEHRGRSSNNSEYTEERFNENNEDCKLETHTRTALDLNTHDENYGTTRPKQFDLNGFSWN

SEQ ID NO: 225 - DNA, 1424 bp, Arabidopsis thaliana
  G1494,family:HLH/MYC
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 226 - protein, 430 aa, Arabidopsis thaliana
  G1494,HLH/MYC domain coordinates 254-311
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 227 - DNA, 1856 bp, Arabidopsis thaliana
  G1498,family:HLH/MYC
tcgacgcctatccagtaccaacctcaattctctagagagagagatatgcatcattttgtccctgacttcgataccgatgatgattatgtcaacaaccataattcttctttgaatcatcttcctagaaaatccattactactatgggtgaagatgatgatcttatggagcttttatggcagaacggtcaagttgttgttcaaaaccagagacttcacaccaagaaaccttcttcttctccaccgaagcttcttccttctatggatcctcagcagcaaccttcttcagatcagaatctttttattcaagaagatgaaatgacttcttggcttcattatcctctccgtgacgatgatttctgctcagatcttctcttctccgccgcacctactgcgacggctaccgcgacggtgagtcaagtcaccgccgcgagaccgccagtatcttcgacgaatgagtcgaggccgccggtgaggaacttcatgaatttctcgaggctgagaggggattttaataacggtagaggtggtgaatctggaccgttgctttcgaaggcggttgtgagagaatctacgcaggtaagtcctagcgcaacaccgtcggcggcggcgagtgaatccggtttaacacggcggacggatggtactgacagttccgccgtagctggaggcggcgcgtataatcggaagggaaaagcagtggctatgacggcgccggcgatcgagataaccggtacatcgtcatctgtagtgtcaaagagcgaaatcgaaccggagaagacgaacgtcgatgataggaaacgaaaagagagagaagccaccactactgatgaaactgaatcccgtagcgaggaaacaaaacaagcacgtgtatcaacaacatctaccaagagatctcgtgctgctgaagttcataatctctctgaaagaaaacggagagataggatcaatgagagaatgaaagctttgcaagaacttatacctcgctgcaacaagtcagataaagcttcgatgctagatgaagctattgagtacatgaaatctcttcagcttcaaatacagatgatgtcaatgggatgtggaatgatgccaatgatgtatccgggcatgcaacagtacatgcctcatatggcgatgggtatgggtatgaaccagcctattcctcctccttccttcatgccattccccaacatgttagccgctcaaagacctttgcctacacaaactcacatggccgggtcaggaccgcaataccctgttcatgcttctgacccgtcaagagtctttgtaccgaaccagcagtatgatccaacctcgggccagcctcagtatccagctggttacacggatccatatcagcagttccgcggtctccacccgacccaaccacctcagtttcagaatcaagcaacatcgtacccaagttcgagcagggtgagtagtagtaaggaatctgaggatcacggaaaccacacaacaggttaataatgtccatggagcaacaagaagatctgttttcacaagcaaacacaatttcttatccgacccgacccaaccacctcagtttcagaatcaagcaacatcgtatccaagttcgagcagggtgagtagtagtaaggaatctgaggatcacggaaaccacacaacaggttaataatgtccatggagcaacaagaagatctgttttcacaagcaaacacaattttgagaaattgacagagagacctaacatgtatatatatcgccatctgtttcttgtttttctttggtttgttttgtcctctcttctcaggttgtatacttagagagctgtacatgtaatgatccagagatctaggaatcaatacatagaggttgca

SEQ ID NO: 228 - protein, 478 aa, Arabidopsis thaliana
  G1498,HLH/MYC domain coordinates 281-338
MHHFVPDFDTDDDYVNNHNSSLNHLPRKSITTMGEDDDLMELLWQNGQVVVQNQRLHTKKPSSSPPKLLPSMDPQQQPSSDQNLFIQEDEMTSWLHYPLRDDDFCSDLLFSAAPTATATATVSQVTAARPPVSSTNESRPPVRNFMNFSRLRGDFNNGRGGESGPLLSKAVVRESTQVSPSATPSAAASESGLTRRTDGTDSSAVAGGGAYNRKGKAVAMTAPAIEITGTSSSVVSKSEIEPEKTNVDDRKRKEREATTTDETESRSEETKQARVSTTSTKRSRAAEVHNLSERKRRDRINERMKALQELIPRCNKSDKASMLDEAIEYMKSLQLQIQMMSMGCGMMPMMYPGMQQYMPHMAMGMGMNQPIPPPSFMPFPNMLAAQRPLPTQTHMAGSGPQYPVHASDPSRVFVPNQQYDPTSGQPQYPAGYTDPYQQFRGLHPTQPPQFQNQATSYPSSSRVSSSKESEDHGNHTTG

SEQ ID NO: 229 - DNA, 1905 bp, Arabidopsis thaliana
  G15,family:AP2
atagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgg

SEQ ID NO: 230 - protein, 555 aa, Arabidopsis thaliana
  G15,AP2 domain coordinates 281-357,383-451
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 231 - DNA, 681 bp, Arabidopsis thaliana
  G1505,family:GATA/Zn
atggatgatatagcggaacttgaatggttatcaaatttcgtagatgattcttctttcacgccgtattctgctccgacgaataaaccggtttggttaaccggaaatcggagacatcttgtacaaccggttaaagaggagacctgcttcaaatcccaacatccggccgtcaaaaccagacccaaacgagccagaaccggagtcagagtctggtctcatggttcgcagtcgttaaccgactcatcttcaagctctacaacatcttcgtcgtcctctcctcgtccttcaagccctctatggctcgccagcggtcagtttcttgatgagccaatgactaaaacacaaaagaagaagaaagtttggaaaaacgctggtcagacgcaaacgcaaacgcagacgcagacgcggcagtgtggtcattgtggagttcagaaaacgccgcagtggagagcaggaccattaggagcgaagacgttgtgtaatgcgtgtggtgtgcgttacaaatcgggtcggttactacccgaatatagacccgcttgtagcccaacattttcgagtgagcttcactcaaaccaccacagtaaagtcattgagatgcgtaggaagaaagagacttctgacggtgctgaagaaaccggtttgaaccagccggttcagacggttcaggttgtctcgagtttttga

SEQ ID NO: 232 - protein, 226 aa, Arabidopsis thaliana
  G1505,GATA/Zn domain coordinates NA
MDDIAELEWLSNFVDDSSFTPYSAPTNKPVWLTGNRRHLVQPVKEETCFKSQHPAVKTRPKRARTGVRVWSHGSQSLTDSSSSSTTSSSSSPRPSSPLWLASGQFLDEPMTKTQKKKKVWKNAGQTQTQTQTQTRQCGHCGVQKTPQWRAGPLGAKTLCNACGVRYKSGRLLPEYRPACSPTFSSELHSNHHSKVIEMRRKKETSDGAEETGLNQPVQTVQVVSSF

SEQ ID NO: 233 - DNA, 1413 bp, Arabidopsis thaliana
  G1506,family:GATA/Zn
atggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatga

SEQ ID NO: 234 - protein, 470 aa, Arabidopsis thaliana
  G1506,GATA/Zn domain coordinates 7-33
MGKQGPCYHCGVTSTPLWRNGPPEKPVLCNACGSRWRTKGSLVNYTPLHARAEGDETEIEDHRTQTVMIKGMSLNKKIPKRKPYQENFTVKRANLEFHTGFKRKALDEEASNRSSSGSVVSNSESCAQSNAWDSTFPCKRRTCVGRPKAASSVEKLTKDLYTILQEQQSSCLSGTSEEDLLFENETPMLLGHGSVLMRDPHSGAREEESEASSLLVESSKSSSVHSVKFGGKAMKQEQVKRSKSQVLGRHSSLLCSIDLKDVFNFDEFIENFTEEEQQKLMKLLPQVDSVDRPDSLRSMFESSQFKENLSLFQQLVADGVFETNSSYAKLEDIKTLAKLALSDPNKSHLLESYYMLKRREIEDCVTTTSRVSSLSPSNNNSLVTIERPCESLNQNFSETRGVMRSPKEVMKIRSKHTEENLENSVSSFKPVSCGGPLVFSYEDNDISDQDLLLDVPSNGSFPQAELLNMI

SEQ ID NO: 235 - DNA, 1197 bp, Arabidopsis thaliana
  G1510,family:GATA/Zn
atggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttga

SEQ ID NO: 236 - protein, 398 aa, Arabidopsis thaliana
  G1510,GATA/Zn domain coordinates 230-263
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 237 - DNA, 1137 bp, Arabidopsis thaliana
  G1517,family:RING/C3HC4
atggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtga

SEQ ID NO: 238 - protein, 378 aa, Arabidopsis thaliana
  G1517,RING/C3HC4 domain coordinates 312-349
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 239 - DNA, 2348 bp, Arabidopsis thaliana
  G1518,family:RING/C3HC4
tcttttctcacaattccgattttctcaaaaaccaaaatcacaatcgaagaaatcttttgaaagcaaaatggaagagatttcgacggatccggttgttccagcggtgaaacctgacccgagaacatcttcagttggtgaaggtgctaatcgtcatgaaaatgacgacggaggaagcggcggttctgagattggagcaccggatctggataaagacttgctttgtccgatttgtatgcagattattaaagatgctttcctcacggcttgtggtcatagtttctgctatatgtgtatcatcacacatcttaggaacaagagtgattgtccctgttgtagccaacacctcaccaataatcagctttaccctaatttcttgctcgataagctattgaagaaaacttcagctcggcatgtgtcaaaaactgcatcgcccttggatcagtttcgggaagcactacaaaggggttgtgatgtgtcaattaaggaggttgataatcttctgacacttcttgcggaaaggaagagaaaaatggaacaggaagaagctgagaggaacatgcagatacttttggactttttgcattgtctaaggaagcaaaaagttgatgaactaaatgaggtgcaaactgatctccagtatattaaagaagatataaatgccgttgagagacatagaatagatttataccgagctagggacagatattctgtaaagttgcggatgctcggagatgatccaagcacaagaaatgcatggccacatgagaagaaccagattggtttcaactccaattctctcagcataagaggaggaaattttgtaggcaattatcaaaacaaaaaggtagaggggaaggcacaaggaagctctcatgggctaccaaagaaggatgcgctgagtgggtcagattcgcaaagtttgaatcagtcaactgtctcaatggctagaaagaaacggattcatgctcagttcaatgatttacaagaatgttacctccaaaagcggcgtcagttggcagaccaaccaaatagtaaacaagaaaatgataagagtgtagtacggagggaaggctatagcaacggccttgcagattttcaatctgtgttgactaccttcactcgctacagtcgtctaagagttatagcagaaatccggcatggggatatatttcattcagccaacattgtatcaagcatagagtttgatcgtgatgatgagctgtttgccactgctggtgtttctagatgtataaaggtttttgacttctcttcggttgtaaatgaaccagcagatatgcagtgtccgattgtggagatgtcaactcggtctaaacttagttgcttgagttggaataagcatgaaaaaaatcacatagcaagcagtgattatgaaggaatagtaacagtgtgggatgtaactactaggcagagtcttatggagtatgaagagcacgaaaaacgtgcctggagtgttgacttttcacgaacagaaccatcaatgcttgtatctggtagtgacgactgcaaggttaaagtttggtgcacgaggcaggaagcaagtgtgattaatattgatatgaaagcaaacatatgttgtgtcaagtacaatcctggctcaagcaactacattgcggtcggatcagctgatcatcacatccattattacgatctaagaaacataagccaaccacttcatgtcttcagtggacacaagaaagcagtttcctatgttaaatttttgtccaacaacgagctcgcttctgcgtccacagatagcacactacgcttatgggatgtcaaagacaacttgccagttcgaacattcagaggacatactaacgagaagaactttgtgggtctcacagtgaacagcgagtatctcgcctgtggaagcgagacaaacgaagtatatgtatatcacaaggaaatcacgagacccgtgacatcgcacagatttggatcgccagacatggacgatgcagaggaagaggcaggttcctactttattagtgcggtttgctggaagagtgatagtcccacgatgttgactgcgaatagtcaaggaaccatcaaagttctggtactcgctgcgtgattctagtagacattacaaaagatcttatagcttcgtgaatcaataaaaacaaatttgccgtctatgttctttagtgggagttacatatagagagagaacaatttattaaaagtagggttcatcatttggaaagcaactttgtattattatgcttgccttggaacactcctcaagaagaatttgtatcagtgatgtagatatgtcttacggtttcttagcttctactttatataattaaatgttagaatcaaaa

SEQ ID NO: 240 - protein, 675 aa, Arabidopsis thaliana
  G1518,RING/C3HC4 domain coordinates 51-93,126-209,374-670
MEEISTDPVVPAVKPDPRTSSVGEGANRHENDDGGSGGSEIGAPDLDKDLLCPICMQIIKDAFLTACGHSFCYMCIITHLRNKSDCPCCSQHLTNNQLYPNFLLDKLLKKTSARHVSKTASPLDQFREALQRGCDVSIKEVDNLLTLLAERKRKMEQEEAERNMQILLDFLHCLRKQKVDELNEVQTDLQYIKEDINAVERHRIDLYRARDRYSVKLRMLGDDPSTRNAWPHEKNQIGFNSNSLSIRGGNFVGNYQNKKVEGKAQGSSHGLPKKDALSGSDSQSLNQSTVSMARKKRIHAQFNDLQECYLQKRRQLADQPNSKQENDKSVVRREGYSNGLADFQSVLTTFTRYSRLRVIAEIRHGDIFHSANIVSSIEFDRDDELFATAGVSRCIKVFDFSSVVNEPADMQCPIVEMSTRSKLSCLSWNKHEKNHIASSDYEGIVTVWDVTTRQSLMEYEEHEKRAWSVDFSRTEPSMLVSGSDDCKVKVWCTRQEASVINIDMKANICCVKYNPGSSNYIAVGSADHHIHYYDLRNISQPLHVFSGHKKAVSYVKFLSNNELASASTDSTLRLWDVKDNLPVRTFRGHTNEKNFVGLTVNSEYLACGSETNEVYVYHKEITRPVTSHRFGSPDMDDAEEEAGSYFISAVCWKSDSPTMLTANSQGTIKVLVLAA

SEQ ID NO: 241 - DNA, 891 bp, Arabidopsis thaliana
  G1521,family:RING/C3HC4
atgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaa

SEQ ID NO: 242 - protein, 296 aa, Arabidopsis thaliana
  G1521,RING/C3HC4 domain coordinates 39-80
MPPLPSSTAPSSSRHLRSPESIAKFAGRAIFPALQGKSCPICLENLTERRSAAVITVCKHGYCLACIRKWSSFKRNCPLCNTRFDSWFIVSDFASRKYHKEQLPILRDRETLTYHRNNPSDRRRIIQRSRDVLENSSSRSRPLPWRRSFGRPGSVPDSVIFQRKLQWRASIYTKQLRAVRLHSRRLELSLAVNDYTKAKITERIEPWIRRELQAVLGDPDPSVIVHFASALFIKRLERENNRQTGQTGMLVEDEVSSLRKFLSDKVDIFWHELRCFAESILTMETYDAVVEYNEVE

SEQ ID NO: 243 - DNA, 822 bp, Arabidopsis thaliana
  G1527,family:RING/C3HC4
ggcatgaatcatcatcatcgctttgctttcttgattctctatttcgtttgatgggatttgtttttctgggaatttattcattctcctgctgccatggctaaattatctttcaaggattctcttaaagctcttgaagccgatattcaacacgctaatacactagctttagattatcctcgggagaaggatggagcgcgcgttcagatgagattatcatacagcccgactgctcaattttttctttttcttgtacaatggactgattgtaagcttgctggtttcctcggtttactcagagttcttatttatatgacttatgcagatgggaaaacaaccatgtcggtttacgaaagaaaagccagtattagagagttccaagacatagatgacagcaaacaaaaagaggtatgcaagatgcgatacagaaagaaggatgagagcgaaatgtcggagattgagatcgagagggaagaagaatgtggaatctgtatggagatgaacagcaaggtggtgctaccaaactgtactcattctttatgcatcaagtgttaccgcgattggcgagggagatcacagtcatgcccgttctgcagagacagccttaaaagagtagattcaggtgatctctggatgtttttggaccaaaacgatacagtgaatctcactgcaatcgctagagagaaccagaaacgattgtttatgtacattgagaagttaccactagtggttccagatcaagtgtatgcgtcttctccttacgatttccatgtgagatgaaggcggaaaaccggttctggtaaatctttatctgtatacttgggg

SEQ ID NO: 244 - protein, 227 aa, Arabidopsis thaliana
  G1527,RING/C3HC4 domain coordinates 129-166
MAKLSFKDSLKALEADIQHANTLALDYPREKDGARVQMRLSYSPTAQFFLFLVQWTDCKLAGFLGLLRVLIYMTYADGKTTMSVYERKASIREFQDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 245 - DNA, 547 bp, Arabidopsis thaliana
  G1530,family:RING/C3H2C3
aacttgtctgagttccaatgcggctgctgctatcatctgatccccaacccgaacttacgtctacatgtacctctcatagttgcggctggaagccttactctcattccaatgactttgctgccaacgcgttcctccttctcatcatcctcttctgttctttcatatgcgtcctctctctccacgctgctatccgttgttgcctccgtccagtcctccaacatgtccctaagcccgacccggaccttgaggccacccatccagacgctcccccgacacttgtctactccccgggcctaaacctagcaggcaatgaagcagagtgcatcatttgtttgtctgaattccaagacggtgacaccttacgcgtgttggagagatgcaaacatggattccacgtttattgcatccagaagtggctctcctcatcccattcttcttgtcccacttgccggacaaacatcttctcctccccacctcaacttcactcacaaagcttaccactaacgagtacaccttagtcagatggtagctagttcctggtcttgcc

SEQ ID NO: 246 - protein, 166 aa, Arabidopsis thaliana
  G1530,RING/C3H2C3 domain coordinates 102-144
MRLLLSSDPQPELTSTCTSHSCGWKPYSHSNDFAANAFLLLIILFCSFICVLSLHAAIRCCLRPVLQHVPKPDPDLEATHPDAPPTLVYSPGLNLAGNEAECIICLSEFQDGDTLRVLERCKHGFHVYCIQKWLSSSHSSCPTCRTNIFSSPPQLHSQSLPLTSTP

SEQ ID NO: 247 - DNA, 666 bp, Arabidopsis thaliana
  G1531,family:RING/C3HC4
atgtgtgagtcaagcaacaaagtcagagtatcgccatacccgcttcggtcttcgaggaccgacaaacacaaggcgtcagagtcgcctattgagacaggttgggaggatgtgcgtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtga

SEQ ID NO: 248 - protein, 221 aa, Arabidopsis thaliana
  G1531,RING/C3HC4 domain coordinates 41-77
MCESSNKVRVSPYPLRSSRTDKHKASESPIETGWEDVRGCHPYMCDTSVRHSNCFKQFRRKTIKKRLYPKTLHCPLCRGEVSETTKVTSTARRFMNAKPRSCSVEDCKFSGTFSQLTKHLKTEHRGIVPPKVDPLRQQRWEMMERHSEYVELMTAAGISRMAEVMQQQLPQDQNHPHVFQVTVNGTIWNLIDPSQGRNGLGITNYSAMQFVPLSINHSRTL

SEQ ID NO: 249 - DNA, 2385 bp, Arabidopsis thaliana
  G1535,family:HB
atgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctag

SEQ ID NO: 250 - protein, 794 aa, Arabidopsis thaliana
  G1535,HB domain coordinates 109-169
MLTMGEGNVMTSNNRFASPPQQPSSSSPGTIQNPNFNFIPFNSYSSIIPKEEHGMMSMMMMMGDGTVEEMMENGSAGGSFGSGSEQAEDPKFGNESDVNELHDDEQPPPAKKKRYHRHTNRQIQEMEALFKENPHPDDKQRKRLSAELGLKPRQVKFWFQNRRTQMKAQQDRNENVMLRAENDNLKSENCHLQAELRCLSCPSCGGPTVLGDIPFNEIHIENCRLREELDRLCCIASRYTGRPMQSMPPSQPLINPSPMLPHHQPSLELDMSVYAGNFPEQSCTDMMMLPPQDTACFFPDQTANNNNNNNMLLADEEKVIAMEFAVSCVQELTKMCDTEEPLWIKKKSDKIGGEILCLNEEEYMRLFPWPMENQNNKGDFLREASKANAVVIMNSITLVDAFLNADKWSEMFCSIVARAKTVQIISSGVSGASGSLLLMFAELQVLSPLVPTREAYFLRYVEQNAETGNWAIVDFPIDSFHDQMQPMNTITHEYKRKPSGCIIQDMPNGYSQVKWVEHVEVDEKHVHETFAEYVKSGMAFGANRWLDVLQRQCERIASLMARNITDLGVISSAEARRNIMRLSQRLVKTFCVNISTAYGQSWTALSETTKDTVRITTRKMCEPGQPTGVVLCAVSTTWLPFSHHQVFDLIRDQHHQSLVASNSWHNVELMLQESCIDNSGSLIVYSTVDVDSIQQAMNGEDSSNIPILPLGFSIVPVNPPEGISVNSHSPPSCLLTVGIQVLASNVPTAKPNLSTVTTINNHLCATVNQITSALSNTITPVIASSADVSNQEVS

SEQ ID NO: 251 - DNA, 462 bp, Arabidopsis thaliana
  G1538,family:HB
atggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataa

SEQ ID NO: 252 - protein, 153 aa, Arabidopsis thaliana
  G1538,HB domain coordinates 66-126
MDHGRLMDDQMMLGSQVYPYTTQPQNSHCIIVNQIDGGEESKPVKRRRKRRSKGSSATNEEDVAEIGGMLRKRKLTDEQVNMLEYSFGNEHKLESGRKEKIAGELGLDPRQVAVWFQNRRARWKNKKLEEEYAKLKNHHDNVVLGQCQLESQV

SEQ ID NO: 253 - DNA, 985 bp, Arabidopsis thaliana
  G154,family:MADS
ctctacctatacatacacaaaccctttatcctcgaaagcttcctcctggttaggtttttatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactgagagtgtataaggacaagtaacaaaactctaaagctgcttctctcttgttgtcttatttctctctcactctctctctctcagtcacttctttaatgattctgaactgcttgtgttatgtatctatgttcttacacttgcctctctagaatgtaattttgattatgttttgttttca

SEQ ID NO: 254 - protein, 214 aa, Arabidopsis thaliana
  G154,MADS domain coordinates 2-57
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 255 - DNA, 1227 bp, Arabidopsis thaliana
  G1540,family:HB
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 256 - protein, 291 aa, Arabidopsis thaliana
  G1540,HB domain coordinates 35-98
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 257 - DNA, 828 bp, Arabidopsis thaliana
  G1543,family:HB
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 258 - protein, 275 aa, Arabidopsis thaliana
  G1543,HB domain coordinates 135-195
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 259 - DNA, 774 bp, Arabidopsis thaliana
  G1549,family:HB
caaaagaggtaaaaaaaaagaagaagagaagatggaatattggagcagctccttcatcgatggcgcgtcttcttccagcttcatctctcctttctataactttgaccatttttcaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagagctaatacaactgaaatcaatgataagagaggatagttcatgcaagaagaaacaaacctgggaaaaagcctgcagctgaggcaatagtatataagttccacttcagttatatctccaaaatggctcaaatttgtagctttagtcccaaacaagcaacaatttctatggctgattctgttttcctttgtattaagtattgtttaagtgattttcgtgtaaagggttctttactaagttgaagttaatgaagaaacatcgtgattc

SEQ ID NO: 260 - protein, 185 aa, Arabidopsis thaliana
  G1549,HB domain coordinates 75-135
MEYWSSSFIDGASSSSFISPFYNFDHFSGNQDNRCLGTMMGAQQDILHVPLAMVESGYGEESNSFNGQEKKKKKMTSEQLKFLERSFQEEIKLNPDRKMKLNPDRKMKLSKELGLQPRQIAVWFQNRKARWKNKQLEHLYESLRQEFDIVSREKELLQEELIQLKSMIREDSSCKKKQTWEKACS

SEQ ID NO: 261 - DNA, 1599 bp, Arabidopsis thaliana
  G1550,family:HB
atggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccttacccaaaggattctgataagatcatgctagcaagacaaacgggcttgagccgcggtcaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttga

SEQ ID NO: 262 - protein, 532 aa, Arabidopsis thaliana
  G1550,HB domain coordinates NA
MENYPETQFIPGDSMIQNAIVSYSEESAGRERRTEANNVSASQERQALSRFGGVPQMQNIGQDFGSWRDQASDRNGFQLMSAMAGATGILQTGQGLSLSLGSQILPGIHQISHQNMAPRGNEYATQSFPGGNQNLDVVRTIPNSKYLKAAQQLLDEAVNVKKALKQFQAEGDKNNENPQEPNQSTQDSSTNPPADISQSERQEMQSKLTKLLSMLDEVDRRYKQYYQQMQIVVSSFDVIAGYGAAKPYTALALQTISRHFRSLRDAISGQILVLRKCLGEQQDGSDGKRVGIISRLKYVDQHLRQQRGFMQPQAWRPQRGLPENSVLILRAWLFEHFLHPYPKDSDKIMLARQTGLSRGQVSNWFINARVRLWKPMVEEIYKEEFTENDSNSSSENTPKMSEIGPVAADDEDRAREFSQDQTKPDHGHGYGEETRGMVQGSHMDGRRFMAVEPTYHVADTSRLGRGDVSLTLGLQNSQGQDNVVAMSSEAYNNFSGVDIYENAIPGDEMEYVNPGSRQNRINSSQLVHDFVA

SEQ ID NO: 263 - DNA, 875 bp, Arabidopsis thaliana
  G1551,family:HB
cttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagacccaatgatgtcatctttaggtcataagatgacagctagacagaggtggactcctacgccagtccagcttcagattctggaacgtatattcgatcaaggcacgggaacaccgagcaagcagaagatcaaagacataacagaagagctgagccaacacggccagattgctgaacaaaatgtctataactggttccagaaccgacgtgctcgatccaagaggaagcagcatggtggaggttcttctggaaataataatggtgagtctgaggtagagactgaagttgaagcattgaatgagaagagagtagtgaggccagagagtcttcttggtcttccagatggaaatagcaacaataatgggttagggacaacaacagcaacaactactgctcctaggcctgaagatctttgctttcagagccctgagattagctcagaccttcacttgctagatgttctatcaaacccaagggatgagcatcttgttggaaagatgggactggcggaaagttacaacctttatgatcatgttgaagattatggcatgtcaggctgattgaatacaagctgaggaaacttctaattatcagagagatc

SEQ ID NO: 264 - protein, 268 aa, Arabidopsis thaliana
  G1551,HB domain coordinates 99-160
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 265 - DNA, 2184 bp, Arabidopsis thaliana
  G1553,family:ARF
aaaaaaaaaagagaaatattttaatcaattcttctttatcacaaagagtgcctttgtattaatgaattttgatgttgtgtaatgaatacagacataaccgtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcgatggcgaatgtggaagctgatttcagaacatcagggtctaatgatgatgaattgtacacggagctatggaaagcttgtgcagggccacttgtggaagttcctcgttatggtgaaagagttttctacttccctcaaggtcacatggaacaattggttgcttcgactaatcaaggagttgttgatcaagagataccagtgtttaatcttcctccaaagatactttgtcgtgttcttagtgttacgttaaaagcagaacatgagaccgatgaggtttacgctcagatcacattacaaccagaagaagatcaaagtgaaccaacaagtcttgacccacctttagtagaaccagctaaaccaacggttgattcttttgtgaagattctaacagcttcagatacaagcacacatggtggattctctgttcttcgtaaacacgccactgagtgtttaccttcacttgatatgacacaacctacaccgactcaagaacttgtagctagagatcttcacggctatgaatggaggtttaagcatatatttagagggcaaccgaggaggcatttacttacaaccggttggagtacatttgtaacctcgaaaagacttgtagctggagatgcatttgtgttcttgaggggtgaaaccggggatttacgggttggtgtgaggcgtttagctaagcagcaaagcacgatgcccgcatccgttatttcgagtcagagtatgcgtttgggagttcttgctacagcttctcatgctgttaccacaacaactatatttgttgtcttctataaaccaaggataagccagtttataattagtgtgaacaagtatatgatggcgatgaagaacgggttttctctcggtatgcggtataggatgagattcgaaggagaagagtctcctgagagaatatttacaggtaccattattggcagtggagatctatcttctcaatggccagcttccaaatggaggtcattgcagatccaatgggacgagccatcttctatacagagaccaaacaaggtctcaccgtgggagatcgagcctttctcaccatccgcgcttacaccaacccctactcaacaacaatcaaagtccaaacggtccagaccaatctcagaaatcacagggagtcctgtagcttctagtttcttgagtagtttctcgcagagccacgagtctaatccatcggtcaaactgttgtttcaagatccagcaaccgagagaaactcaaacaaatcagtgttttcaagtggattacaatgcaagataaccgaggctccggtcacaagtagttgtaggttattcggattcgatctcacgagcaagcctgcttctgctacaattcctcatgacaagcagctaataagtgtggattcaaatatatctgattctaccaccaagtgtcaagatcctaactcttcaaactcaccaaaagagcagaaacaacaaacatccacaagaagccgaatcaaggtgcaaatgcaaggaacagcggttggacgcgcggttgatttaacattgttgagatcatacgatgaactaataaaagagctagagaaaatgtttgagattgaaggagaacttagtcctaaagacaaatgggctatcgtgtttacagacgatgaaggagataggatgcttgtaggagatgatccatggaatgagttctgtaaaatggcaaagaagttattcatatatccgagtgatgaggtcaagaaaatgaggtcgaagtcgttgttgggtgataaaggtacgatcgtaaatcttgaatcagatcagaggacagttcacgtttaactatcaagttgttgatttcttactttcttggagactctctcaagtctcaccaagtccgagagttaggtggtttttttttttttggttttttttt

SEQ ID NO: 266 - protein, 601 aa, Arabidopsis thaliana
  G1553,ARF domain coordinates 20-351
MANVEADFRTSGSNDDELYTELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPTVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGMRYRMRFEGEESPERIFTGTIIGSGDLSSQWPASKWRSLQIQWDEPSSIQRPNKVSPWEIEPFSPSALTPTPTQQQSKSKRSRPISEITGSPVASSFLSSFSQSHESNPSVKLLFQDPATERNSNKSVFSSGLQCKITEAPVTSSCRLFGFDLTSKPASATIPHDKQLISVDSNISDSTTKCQDPNSSNSPKEQKQQTSTRSRIKVQMQGTAVGRAVDLTLLRSYDELIKELEKMFEIEGELSPKDKWAIVFTDDEGDRMLVGDDPWNEFCKMAKKLFIYPSDEVKKMRSKSLLGDKGTIVNLESDQRTVHV

SEQ ID NO: 267 - DNA, 1325 bp, Arabidopsis thaliana
  G1559,family:TH
ctccttcttccttggagaaaacatgtttgtttccgataacaacaatccttcacgggacataaacatgatgatcggcgatgttacatcaaacggagatctacagccacaccagatcatcctcggagaaagcagtggaggagaggatcatgagatcatcaaagcaccaaagaaacgagcagagacatgggcacaagacgagactcgaaccttaatctcattacggagagaaatggacaatcttttcaacacttccaaatctaacaaacatctctgggaacagatttctaagaaaatgagagagaaagggtttgatcgatcaccatctatgtgtacggacaagtggaggaacatattgaaagagtttaagaaagctaagcaacatgaagataaagcaacaagtggaggatcaacgaagatgtcttattacaatgagattgaagatattttcagagaaagaaagaagaaagtggcattctataagagtcctgctactactacaccatcttctgctaaagttgattcctttatgcaatttacagataaaggttttgaagatactggtatttcatttacatctgttgaagctaatggcaggccaacgctaaatcttgaaacggagcttgatcatgatggtcttcctctccccattgctgctgatcccatcacagcaaatggagttcctccttggaattggagagacacccctggaaatggcgttgatggtcagccatttgctgggaggatcataacggtgaaatttggagattacacaagacgagttgggattgatggtactgctgaagcaattaaggaagctatcagatccgcgtttagattgagaacaagacgagctttttggctagaagatgaagaacaggttattcgctctcttgaccgagacatgcctttagggaactatatactccgcattgatgaagggatagccgttagagtgtgccactatgatgaatctgatccgttaccagtccatcaagaggagaagatattctacaccgaagaagattaccgagatttcttggctcgacgaggatggacatgtctgagagagtttgacgcgtttcaaaacatagacaatatggacgagcttcaatccggtcgcttatacagaggaatgagatgagaaaacggttactacagaaggctagaagaaaccttttatttttcatcagtcactataaatagctttttttgatccaaaatactttattttcatcagtcactgtacatatgcacctcttttgacatgccattgtgaatcagaggaatttgatttgtttattgagaaaacacaaaaagaaaaaaaa

SEQ ID NO: 268 - protein, 372 aa, Arabidopsis thaliana
  G1559,TH domain coordinates 55-154
MFVSDNNNPSRDINMMIGDVTSNGDLQPHQIILGESSGGEDHEIIKAPKKRAETWAQDETRTLISLRREMDNLFNTSKSNKHLWEQISKKMREKGFDRSPSMCTDKWRNILKEFKKAKQHEDKATSGGSTKMSYYNEIEDIFRERKKKVAFYKSPATTTPSSAKVDSFMQFTDKGFEDTGISFTSVEANGRPTLNLETELDHDGLPLPIAADPITANGVPPWNWRDTPGNGVDGQPFAGRIITVKFGDYTRRVGIDGTAEAIKEAIRSAFRLRTRRAFWLEDEEQVIRSLDRDMPLGNYILRIDEGIAVRVCHYDESDPLPVHQEEKIFYTEEDYRDFLARRGWTCLREFDAFQNIDNMDELQSGRLYRGMR

SEQ ID NO: 269 - DNA, 947 bp, Arabidopsis thaliana
  misc_feature (924)..(925): n is a, c, g, or t
  misc_feature (929)..(929): n is a, c, g, or t
  misc_feature (932)..(933): n is a, c, g, or t
  G156,family:MADS
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 270 - protein, 238 aa, Arabidopsis thaliana
  G156,MADS domain coordinates 2-57
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 271 - DNA, 883 bp, Arabidopsis thaliana
  G157,family:MADS
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 272 - protein, 196 aa, Arabidopsis thaliana
  G157,MADS domain coordinates 2-57
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 273 - DNA, 1132 bp, Arabidopsis thaliana
  G159,family:MADS
tcataattttgtttcttataaatcactatagaaaaaaatattttctttcaatgctcaaaacatattttgtaaaatttagtctataaatacaaatacctattatctctaatataatcaactcgcttttctttttctgttcaaaacatctcgaaaatggcgagaaagaatcttggtcgtagaaaaatagagttggtaaaaatgaccaacgaatcaaaccttcaagttacgttttcaaaaagaagatctggtcttttcaaaaaaggcagtgaactttgcaccttatgtgacgcggaaattgcgataatcgtgttttcaccctcgggaaaagcatactcttttggtcatccaaatgttaacaagttacttgaccactctttagggcgtgttataagacacaacaacacaaactttgctgaaagccgcacaaagctccgtattcaaatgctcaatgagtctttaactgaggtgatggctgaaaaagaaaaagaacaagagaccaagcagtcaatagtccaaaatgaaagagagaacaaggacgctgagaagtggtggaggaactctccaacagaactcaacttagctcaatcaacttccatgaaatgtgatcttgaagctttgaagaaggaagttgatgaaaaagtcgctcaacttcatcatagaaacctaaacttctatgttggaagttctagcaatgttgctgctccagcagctgttagtggtggtaatatctccacaaaccatggtttctttgatcaaaacggaaactctacttctgctccaacactgccgtttggatttaatgttatgaatcgcacaccagctgggtacaacagttaccaactccaaaaccaggaggttaaacaagtccatcctcagtattgggctcgttactattagtctatctctctcgttgtgtgactttttaagtctccaatagtttgttctgctttttgttttgtttttgtttgttgttgttgttgttgtcgggcttttaattaagtctcgagtcaactagtttcttgtttcttttcgttatactttgtcttgtagctttatatcattttcttgtggaatatgagtaagctatatgaagtttcatattaaaaaaaaaaaaaaaaaaaaaaaaaaaaaa

SEQ ID NO: 274 - protein, 247 aa, Arabidopsis thaliana
  G159,MADS domain coordinates 7-61
MARKNLGRRKIELVKMTNESNLQVTFSKRRSGLFKKGSELCTLCDAEIAIIVFSPSGKAYSFGHPNVNKLLDHSLGRVIRHNNTNFAESRTKLRIQMLNESLTEVMAEKEKEQETKQSIVQNERENKDAEKWWRNSPTELNLAQSTSMKCDLEALKKEVDEKVAQLHHRNLNFYVGSSSNVAAPAAVSGGNISTNHGFFDQNGNSTSAPTLPFGFNVMNRTPAGYNSYQLQNQEVKQVHPQYWARYY

SEQ ID NO: 275 - DNA, 1449 bp, Arabidopsis thaliana
  G1592,family:HB
atggccacttattacaaaactggctcaagtgagatttattccagaccagaatttgtccctggaaacgcaatgaactacacaaattctttcacagagacatttcctagagattcaactaataatgtgtcaccttcaaaagagattcaagtgttgtcaagccttggtggagtttcacaaatggttgagattcaagattctggttcttggagagatcaagaagacaatgacaggaatcgcttcccggtgatgaggcgtcttggcctcagctcgcagattgagacatcgagaggcaataataacaatgagtatgcaacacaggttgtttcgggatttactcgaaccattcacaactcaaagtatctcaaagctgctcaagagcttcttgatgaaactgttaatgttaagaaagctctaaagcagtttcagccagagggagataagattaatgaagtgaaagagaagaatcttcagacgaatactgctgaaatccctcaagcagagaggcaagaattgcagagcaagttgtcgaaacttttatcgatattagacgaggtggatagaaattacaagcagtattaccatcagatgcagatagtcgtgtcgtctttcgatgtaatagccggatgtggagcagccaaaccatacacagcccttgcgcttcagaccatctcgaggcatttccgttgcttaagggatgcgatatccggacaaatcttggtgataaggaaaagtttaggaggggaacaggatggatcagatgggagaggagtggggataagcaggttaaggaatgttgatcaacaggtaaggcaacaaagagcgttgcagcggttaggtgtgatgcaacctcacacttggcggcctcaacgcggtttaccagattcttctgttttggttctccgtgcttggctatttgagcatttcctccacccttatccaaaggattcagacaagatcatgctcgctagacaaacggggttgagccgaggccaggtatcgaactggttcataaatgcgcgtgtgcgtctctggaaaccgatggtggaggagatgtacaaggaggaattcacagatgcattgcaggagaatgatcccaaccagtcttctgaaaacacaccagaaatcaccgagattcaagagctgcaaactgagtctagttccaacaatgggcatgtacctggtgtggcaagcagtagcatgagacaaaacacagtggcccatggtggtgaccggttcatgatggtgactgacatgacaagaaatggtaatggtgggatgtctttaacgttggggattcagaattccgatgctcgtggcgatgttcctatgtccggtgggatagataactacaagaataccatctcgggaaccgatctacagtacttaaactctcgcaaccaccagcaccagattggctcttcacaattgttgcatgattttgtagcttga

SEQ ID NO: 276 - protein, 482 aa, Arabidopsis thaliana
  G1592,HB domain coordinates NA
MATYYKTGSSEIYSRPEFVPGNAMNYTNSFTETFPRDSTNNVSPSKEIQVLSSLGGVSQMVEIQDSGSWRDQEDNDRNRFPVMRRLGLSSQIETSRGNNNNEYATQVVSGFTRTIHNSKYLKAAQELLDETVNVKKALKQFQPEGDKINEVKEKNLQTNTAEIPQAERQELQSKLSKLLSILDEVDRNYKQYYHQMQIVVSSFDVIAGCGAAKPYTALALQTISRHFRCLRDAISGQILVIRKSLGGEQDGSDGRGVGISRLRNVDQQVRQQRALQRLGVMQPHTWRPQRGLPDSSVLVLRAWLFEHFLHPYPKDSDKIMLARQTGLSRGQVSNWFINARVRLWKPMVEEMYKEEFTDALQENDPNQSSENTPEITEIQELQTESSSNNGHVPGVASSSMRQNTVAHGGDRFMMVTDMTRNGNGGMSLTLGIQNSDARGDVPMSGGIDNYKNTISGTDLQYLNSRNHQHQIGSSQLLHDFVA

SEQ ID NO: 277 - DNA, 896 bp, Arabidopsis thaliana
  G1634,family:MYB-related
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 278 - protein, 277 aa, Arabidopsis thaliana
  G1634,MYB-related domain coordinates 29-79,131-179
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 279 - DNA, 1164 bp, Arabidopsis thaliana
  G1635,family:MYB-related
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 280 - protein, 387 aa, Arabidopsis thaliana
  G1635,MYB-related domain coordinates 56-102
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 281 - DNA, 954 bp, Arabidopsis thaliana
  G1637,family:MYB-related
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 282 - protein, 317 aa, Arabidopsis thaliana
  G1637,MYB-related domain coordinates 108-156
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 283 - DNA, 942 bp, Arabidopsis thaliana
  G1638,family:MYB-related
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcg

SEQ ID NO: 284 - protein, 298 aa, Arabidopsis thaliana
  G1638,MYB-related domain coordinates 27-77,141-189
MNRGIEVMSPATYLETSNWLFQENRGTKWTAEENKKFENALAFYDKDTPDRWSRVAAMLPGKTVGDVIKQYRELEEDVSDIEAGLIPIPGYASDSFTLDWGGYDGASGNNGFNMNGYYFSAAGGKRGSAARTAEHERKKGVPWTEEEHRQFLMGLKKYGKGDWRNIARNFVTTRTPTQVASHAQKYFIRQVNGGKDKRRSSIHDITTVNIPDSPDAAAADNATANAPCSPPSVGGNQRETSEWEGQTLYDETAAAFYNQNAFSETLLGMSSTPYMAKLQEQSFLNASQFESYNAYLQM

SEQ ID NO: 285 - DNA, 1127 bp, Arabidopsis thaliana
  G1640,family:MYB-(R1)R2R3
ctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattg

SEQ ID NO: 286 - protein, 342 aa, Arabidopsis thaliana
  G1640,MYB-(R1)R2R3 domain coordinates 14-115
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 287 - DNA, 1077 bp, Arabidopsis thaliana
  G1642,family:MYB-(R1)R2R3
atgggtcatcactcatgctgcaacaagcaaaaggtgaagagagggctttggtcacctgaagaagacgaaaagctcatcaactacatcaattcatatggccatggatgttggagctctgttcctaaacatgcaggtttgcagagatgtggaaagagttgtagattaagatggataaattatctaagacctgatcttaaacgtggaagcttctctcctcaagaagctgctcttatcattgagcttcacagcattcttggtaacagatgggctcaaattgctaaacatctacctggaagaacagataacgaggtcaagaatttctggaactcgagcattaaaaagaagctcatgtctcaccatcatcacggtcatcatcatcatcatctctcttccatggcgagtttgctcacaaaccttccttatcacaatggattcaaccctactacagtcgacgatgaaagttcaagattcatgtccaatatcatcacaaacactaaccctaatttcatcactccaagccatctctctcttccttctcctcatgttatgaccccattgatgttcccaacctctagagaaggagatttcaagtttctaaccacaaacaacccaaaccaatctcatcaccatgataataaccattacaacaacctcgacattttgtcacccacaccaactataaacaatcatcatcaaccttcactttcttcttgtcctcatgataataatctccaatggccagcgttaccagatttcccagcgagtaccatttctggtttccaagaaacccttcaagattatgatgatgctaataaactcaacgtgtttgtgacaccattcaacgataatgccaaaaagttattatgtggagaagttctcgaaggcaaagtactatcttcctcctcaccaatttcacaagatcacggcctttttcttcccaccacgtacaactttcaaatgacttctacgagtgatcatcaacatcatcatcgagtggactcatacatcaatcacatgatcataccatcatcatcctcatcgtcgccaatctcttgtggacagtacgtcataacttaa

SEQ ID NO: 288 - protein, 358 aa, Arabidopsis thaliana
  G1642,MYB-(R1)R2R3 domain coordinates NA
MGHHSCCNKQKVKRGLWSPEEDEKLINYINSYGHGCWSSVPKHAGLQRCGKSCRLRWINYLRPDLKRGSFSPQEAALIIELHSILGNRWAQIAKHLPGRTDNEVKNFWNSSIKKKLMSHHHHGHHHHHLSSMASLLTNLPYHNGFNPTTVDDESSRFMSNIITNTNPNFITPSHLSLPSPHVMTPLMFPTSREGDFKFLTTNNPNQSHHHDNNHYNNLDILSPTPTINNHHQPSLSSCPHDNNLQWPALPDFPASTISGFQETLQDYDDANKLNVFVTPFNDNAKKLLCGEVLEGKVLSSSSPISQDHGLFLPTTYNFQMTSTSDHQHHHRVDSYINHMIIPSSSSSSPISCGQYVIT

SEQ ID NO: 289 - DNA, 800 bp, Arabidopsis thaliana
  G1646,family:CAAT
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 290 - protein, 250 aa, Arabidopsis thaliana
  G1646,CAAT domain coordinates 66-162
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 291 - DNA, 784 bp, Arabidopsis thaliana
  G165,family:MADS
cttcaaaacatctaaaaaatggtgaaaaaaactcttggtcgtagaaaggtagagatagtgaaaatgactaaggaatcaaaccttcaagtcacattttccaagagaaaagctggtctttttaagaaggctagtgaattttgcacattatgtgatgcaaaaattgcgatgatcgtgttttcaccagctggaaaagtattttcttttggtcatccaaatgttgatgttctgcttgaccactttcgagggtgtgttgtaggacacaacaacacaaaccttgatgaaagctacacaaagcttcatgttcaaatgctcaacaaatcctacactgaggtgaaggcggaagtagaaaaagaacaaaagaataagcagtcgcgggctcaaaatgaaagagaaaacgaaaacgctgaggagtggtggagtaagtctccattagaactcaacttaagtcaatcaacctgtatgatacgtgttcttaaagatttgaagaagatagttgatgaaaaagcaattcaattaatccatcaaacaaacccaaacttctatgttggaagttctagcaatgctgctgctccagcaactgttagtggtggtaatatctccacaaaccaggggttctttgatcaaaacggaatgacgactaatcctactcaaacacttctgtttggatttgatattatgaatcgcacaccaggagtttaaataagtctatcctcattatgggtcttggtactataagttcatctctctcgttgttgactttttaagtctccaatagtttgttgtg

SEQ ID NO: 292 - protein, 226 aa, Arabidopsis thaliana
  G165,MADS domain coordinates 7-62
MVKKTLGRRKVEIVKMTKESNLQVTFSKRKAGLFKKASEFCTLCDAKIAMIVFSPAGKVFSFGHPNVDVLLDHFRGCVVGHNNTNLDESYTKLHVQMLNKSYTEVKAEVEKEQKNKQSRAQNERENENAEEWWSKSPLELNLSQSTCMIRVLKDLKKIVDEKAIQLIHQTNPNFYVGSSSNAAAPATVSGGNISTNQGFFDQNGMTTNPTQTLLFGFDIMNRTPGV

SEQ ID NO: 293 - DNA, 1234 bp, Arabidopsis thaliana
  G1656,family:HLH/MYC
attcataaaccctttacgacaaaacaataaagacgtctctcgatttatctttgtcttaatcaggaaactatttgacatttctttatcgattattacttcatattcgggtatggatgaagattttttcttacccgatttctcactagtagacattgatttcgactttaatatttacgaagaaaataatttatcacctgatgaatctttatcaaattcacgaagagctgatcaatcgtcaaagtttgatcatcaaatgcattttgagtgcctcagagagaagccaaaggcagcggtgaagcctatgatgaagatcaacaacaagcaacaactgatttcttttgatttctctagtaatgttatttcttctccagccgcggaggagatcattatggataaattggttggtcgtggaaccaaaagaaaaacatgttctcatggcacaagatctccggttcttgcgaaagaacatgttttagccgagagaaagcgccgtgagaagctttctgaaaaattcattgctctttcagctctccttcccgggcttaagaaggcggacaaggtaacgattcttgatgacgcgatctcgcgtatgaaacaactccaagaacaactaagaacgctcaaggaagaaaaagaagcaacgagacaaatggaatccatgattcttgtaaagaaatctaaagtgtttttcgacgaggaacctaacctatcatgttctccttcagttcatattgaattcgatcaagcattaccagaaatcgaagcgaaaatttctcaaaatgacattctcatccgaatcctttgcgagaaaagcaaagggtgcatgatcaacatactaaacacaattgaaaactttcaattgcgcattgaaaatagcatcgtattgccattcggagactcgactctcgacatcacagtccttgcacagatggataaagatttttcgatgagtatacttaaggatcttgtacggaacctgagactcgcaatggtttaggtcttctttcaagttttagtaacctgagactgtacattgacacaatcgtttcgtggatttgctatcgttttcttcttgagattttttcacacgtgcccacatgtttgatgtgtttttttagcaaagctatttccgataacgaccgttgagaattaatttagatgtaacattttttgtttgttaataatgaatttaaaatataacagaattgtttttttattaaaaaaaaaaaataaa

SEQ ID NO: 294 - protein, 295 aa, Arabidopsis thaliana
  G1656,HLH/MYC domain coordinates 112-169
MDEDFFLPDFSLVDIDFDFNIYEENNLSPDESLSNSRRADQSSKFDHQMHFECLREKPKAAVKPMMKINNKQQLISFDFSSNVISSPAAEEIIMDKLVGRGTKRKTCSHGTRSPVLAKEHVLAERKRREKLSEKFIALSALLPGLKKADKVTILDDAISRMKQLQEQLRTLKEEKEATRQMESMILVKKSKVFFDEEPNLSCSPSVHIEFDQALPEIEAKISQNDILIRILCEKSKGCMINILNTIENFQLRIENSIVLPFGDSTLDITVLAQMDKDFSMSILKDLVRNLRLAMV

SEQ ID NO: 295 - DNA, 1484 bp, Arabidopsis thaliana
  G1657,family:DBP
caagtgatcgaatatttgattctttttcataatcagagatctgatctaaatggagtatgaccgtacgttgaacttgattccatacggactacaaggagtaagagaggaggaagaaatcgaagaagacgatgaagagagcatgacgttgtcgtcagtaccagaaaacgaaacgtcggagtgttcttcgcctccggcgacgtatcctccaatccctcctcggcctaaaacaccgagagagccgatggagtttctatgcagatcatggagtctttctacttctgagatctctttagctttatcatctcagaaatctgataaacaactcaacaaaaaccctaatatttctcagttggccgatgtcacttctctggctccggtagcaccaccaccgccgctacaaacgggaaagctagcgagtgcggttcacgcgcggagaacgggaacgatcggaaaatggttccaccaccgagaattcgtcggcgggaaggtctccgccgtaaagaagagagatagagttcgcgtggagaaagctcatctgcattccgccgtgtccattgcgtctctggcgacggcaatcgccgcagtgaccgcttcaggcaatcaagacggcttcgctggatcaaagatgagctcagcccttgcctcggcgtcggagttgttagcttctcactgcctcgaattggcggagcttgccggcgccgatcacgatcgcgtcgtctctgctgtccgatcagctgttgatgttcgtggacctggcgatttgttgactctaactgctgcagctgcaacagcattgagaggagaagcagctttgagggtaagactaccaaaggaagctaagaacagtgcagctataagcccctgtgagagagttttaccagagactcatagttgctcttctgagctcgatcgcactagcacgaccgatgaactcatatctgcaaaaggagttgaagaatcaactggagagctaatgcagtgcacacgaaacggtaatgtttcagtcatagtagaaatcaaaagcaaacacgttgtaggagcattctccatgaaaagcaaaggcattgtaaatgatgtatgcgagacagtctcaggcctgcaaaatggaaaagacacggaaaacacagaagaagagctctatttcggaatcggtacagggaaaggtctgacaaagttcaagtgcaagagcaaggctgataagcagacatgggtggatagcatccggaatcttctccatcgagtaactgctgttgaggtcgacacttctcttgaaactataaacattaacgatagcacataaatcatgatgtcttgtgttaacggtgttagtgttggttattttcattacaagccaatgatatgtattgtttcaagaacatatacatatctgcaagtaggtgtagtgtttttcatcttcgtcacttgtttttatttcagtcaaattgtaaacattgttttgtggaaataatgaagaagattataat

SEQ ID NO: 296 - protein, 416 aa, Arabidopsis thaliana
  G1657,DBP domain coordinates 56-97,149-268
MEYDRTLNLIPYGLQGVREEEEIEEDDEESMTLSSVPENETSECSSPPATYPPIPPRPKTPREPMEFLCRSWSLSTSEISLALSSQKSDKQLNKNPNISQLADVTSLAPVAPPPPLQTGKLASAVHARRTGTIGKWFHHREFVGGKVSAVKKRDRVRVEKAHLHSAVSIASLATAIAAVTASGNQDGFAGSKMSSALASASELLASHCLELAELAGADHDRVVSAVRSAVDVRGPGDLLTLTAAAATALRGEAALRVRLPKEAKNSAAISPCERVLPETHSCSSELDRTSTTDELISAKGVEESTGELMQCTRNGNVSVIVEIKSKHVVGAFSMKSKGIVNDVCETVSGLQNGKDTENTEEELYFGIGTGKGLTKFKCKSKADKQTWVDSIRNLLHRVTAVEVDTSLETININDST

SEQ ID NO: 297 - DNA, 541 bp, Arabidopsis thaliana
  G1659,family:DBP
agaacttaaagcctgaaactcattctcaatcaaatggagccaaatattccgatccaaagaggagatgagcagtcaaaagttattaaggcatggaaggaactaaagataacaaaggtcaataacaagactcagaagaagctactagatatttcaggatgggagaaaaagaaaactacaaagatcgaatctgaactcgctagaattcagcggaagatggacagtaagaagatggagaaatctgagaaactaaggaacgaaaaagcggcagttcatgcaaaggcacaaaagaagaaggcagatgttcaaaccagacgggctcaagagatccttgatgcggaagaagctgctgctaggtttcaagccgcaggaaagatacccaagaagtcatctttgagctgcttctgagatcagcactaacctgtgatacagattatcacctatctccggtatcctatgttcatacttgtatcttttgtatgttgtgtgttttgcttgtgttgctcataaaacaagagagtgcaaaattcattgtccataaaaa

SEQ ID NO: 298 - protein, 123 aa, Arabidopsis thaliana
  G1659,DBP domain coordinates 17-116
MEPNIPIQRGDEQSKVIKAWKELKITKVNNKTQKKLLDISGWEKKKTTKIESELARIQRKMDSKKMEKSEKLRNEKAAVHAKAQKKKADVQTRRAQEILDAEEAAARFQAAGKIPKKSSLSCF

SEQ ID NO: 299 - DNA, 1011 bp, Arabidopsis thaliana
  G166,family:MADS
aacaaagcaaaacacatataacaaaaacaatagatatgaagagaaagatgaagttatcgttaatagaaaacagtgtatcgaggaaaacaacattcaccaaaaggaagaaagggatgacgaagaaactaaccgagctagtcactctatgtggtgttgaagcatgtgcggtcgtctatagtccgttcaactcgatcccggaggcttggccgtcaagggaaggcgttgaagacgtggtgtcgaaatttatggagttgtcggtgttggaccggaccaagaagatggtggatcaagagacttttataagtcaaaggatcgccaaagaaaaagagcagctgcagaagctacgtgatgagaaccataattctcagattcgggagttaatgtttggttgtctcaaaggggagacgaatgtgtataatcttgatggaagggatcttcaagatttgagtttatatattgataagtatcttaatggtcttactcgcaggattgagatccttattgagaacggtgagtcttcttcatctttacctcttcctattgttgcgaatgcagctgcaccagtcggatttgatggtcctatgtttcaatatcataatcaaaatcagcaaaagccggttcaattccaatatcaggctctttatgatttttatgatcagattccaaagaaaattcatggttttaatatgaatatgaataaggattcgaatcaaagtatggttttggatttgaatcaaaatcttaatgatggagaggacgagggcattccttgcatggacaacaacaactaccaccccgaaatcgattgtctcgctaccgtcaccactgcccccactgatgtttgtgctcctaacatcaccaatgatctctagtctaagggatgtatttcgagtgaagtgtttgatcgtttgcatttgtgttttctccattttataagacaaaacttatatgtgatgtcttttttattattattaattgttggacaattcttgcgtccacacttatcttatt

SEQ ID NO: 300 - protein, 278 aa, Arabidopsis thaliana
  G166,MADS domain coordinates 2-56
MKRKMKLSLIENSVSRKTTFTKRKKGMTKKLTELVTLCGVEACAVVYSPFNSIPEAWPSREGVEDVVSKFMELSVLDRTKKMVDQETFISQRIAKEKEQLQKLRDENHNSQIRELMFGCLKGETNVYNLDGRDLQDLSLYIDKYLNGLTRRIEILIENGESSSSLPLPIVANAAAPVGFDGPMFQYHNQNQQKPVQFQYQALYDFYDQIPKKIHGFNMNMNKDSNQSMVLDLNQNLNDGEDEGIPCMDNNNYHPEIDCLATVTTAPTDVCAPNITNDL

SEQ ID NO: 301 - DNA, 1721 bp, Arabidopsis thaliana
  G1660,family:DBP
aaagaaaagagagaagctttgagaaagaaagaaagaaagacacagtgtgtatcaatctctgtactttcacaagcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgttgctagtggattagatgattgcaaagatgttgatgttgtgagtgagattactgattgttctacttcagggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgttgttaattctcaagaacacatctttctatcatcatttgtataataaaagctttgaaaaacttatttcttgtgatcttttagaaaaaa

SEQ ID NO: 302 - protein, 486 aa, Arabidopsis thaliana
  G1660,DBP domain coordinates 362-476
MDYERIGKTQVTSSGGGFSPGKLRSMLLLGVDRKKNEEEESTPTMRSGSNQIDDPRVYVASGLDDCKDVDVVSEITDCSTSGIARSISLGLQEYSDYDNVNEIKSVSASSVFEFQKTEKEKVNQRMPIRSFSKPAPSKWDDAQKWIASPTANRPKTGQVQVPGSKKGPSFGRQSSMKIVEVAEHRVVEEPDTKRIDVSQVKKDMGNKFGSWEVDSYTTVDSYVKPVLMVENSIVESATEVNLSRHDSSVATAFAQPPSTARSVSMRDMGTEMTPIASQEPSRNGTPIRATTPIRSPISSEPSSPGRQASASPMSNKELSEKELQMKTRREIMVLGTQLGKFNIAAWASKEDEDKDASTSLKTKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPSLLFSCFSFCS

SEQ ID NO: 303 - DNA, 2331 bp, Arabidopsis thaliana
  G1665,family:HLH/MYC
ccccagcaagtcttgtctccttctctctctctctccctctctaactgtatcttcttcttcttcttcaaccttcagacttttctagttgcaactctcattcaattgttcaatttctctgtaaaaatcaaagctttttggaatctttcttcggcgagatatttcttcaccggcgcaagcttctcttgagcgtgattcatcactgggtttgcattttttcctggtgggtattcttcaaattgttcaaagctccgaccttttcttccttagaatctgattactggaatcttgaagctggagagactcgagtttatatggtttcaagcatcgttgagtcaatcattgagttgtgtagaagaaaggtttggttttcttctccgtttaagtggttttgggtttggtaggatttggtgtaatctgggagataaagaaagatgaatatgagtgatttaggttgggatgatgaagataaatcggtggttagtgctgttttagggcatttagcttctgattttcttcgagcaaactctaattcgaatcagaatctctttcttgttatgggaactgatgatactctgaataagaagctctctagtctcgttgattggccaaactcggagaatttcagctggaactacgctattttctggcaacaaaccatgtctagatccggacaacaagtcttaggttggggagatgggtgttgtcgagagcctaatgaggaagaggaatcaaaagttgttaggtcttataattttaacaacatgggggcagaggaagagacatggcaagatatgaggaagagagtgttgcagaagcttcataggttgtttggtggatctgatgaagacaattatgctttgagcttagagaaagttactgctactgagattttcttcttagcttccatgtatttcttcttcaatcacggtgaaggcggtcctgggaggtgttattcttcagggaaacatgtgtggctctctgatgcagttaactctgagtctgactattgtttcaggtcttttatggcgaaatctgcgggaatcagaacgatcgttatggttcctactgatgctggtgttcttgagcttggttctgtttggtctttgcctgaaaacattggcttggttaagtctgttcaagctttgttcatgaggagagttacgcaaccagtaatggtgacttcaaacactaacatgactggagggattcacaagcttttcgggcaggatttgagtggagctcacgcgtatcctaagaagctcgaagtgagaagaaacttggatgagagattcactcctcaaagttgggaaggctataataacaataaaggtccaacatttggttacacacctcagagggatgatgtgaaagtgctagagaatgtgaatatggttgtagataataacaattacaagacgcagattgagtttgcgggatcatcagttgctgcttcttcgaatccatctacaaacactcagcaagaaaaatcagaatcttgtacagagaaaagaccagtgagcttgttagcaggagcaggaatagtttctgttgttgatgagaagagaccgagaaagagagggagaaagcctgcaaacggaagagaagagccattgaaccatgtggaagctgagaggcagagacgcgagaagcttaaccaaagattctacgctttacgatcagttgttccaaacatttctaaaatggacaaggcttctctacttggagacgcaatttcttacatcaaagagcttcaagagaaagtcaagataatggaagatgaaagagtaggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctggtgatatataagtttcacatgatggtgaagcttttgtctattcttgtttcagtatagataactttcaggttcaactagaaatagataaaatccttttttcttttctctttcttatagtgaaaggaatccggtttaagtatattcattaactttatttagaccattgattcacatatttgtatcttgggaaaatatttcctatactttaga

SEQ ID NO: 304 - protein, 566 aa, Arabidopsis thaliana
  G1665,HLH/MYC domain coordinates NA
MNMSDLGWDDEDKSVVSAVLGHLASDFLRANSNSNQNLFLVMGTDDTLNKKLSSLVDWPNSENFSWNYAIFWQQTMSRSGQQVLGWGDGCCREPNEEEESKVVRSYNFNNMGAEEETWQDMRKRVLQKLHRLFGGSDEDNYALSLEKVTATEIFFLASMYFFFNHGEGGPGRCYSSGKHVWLSDAVNSESDYCFRSFMAKSAGIRTIVMVPTDAGVLELGSVWSLPENIGLVKSVQALFMRRVTQPVMVTSNTNMTGGIHKLFGQDLSGAHAYPKKLEVRRNLDERFTPQSWEGYNNNKGPTFGYTPQRDDVKVLENVNMVVDNNNYKTQIEFAGSSVAASSNPSTNTQQEKSESCTEKRPVSLLAGAGIVSVVDEKRPRKRGRKPANGREEPLNHVEAERQRREKLNQRFYALRSVVPNISKMDKASLLGDAISYIKELQEKVKIMEDERVGTDKSLSESNTITVEESPEVDIQAMNEEVVVRVISPLDSHPASRIIQAMRNSNVSLMEAKLSLAEDTMFHTFVIKSNNGSDPLTKEKLIAAFYPETSSTQPPLPSSSSQVSGDI

SEQ ID NO: 305 - DNA, 1891 bp, Arabidopsis thaliana
  G1666,family:HLH/MYC
catcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 306 - protein, 518 aa, Arabidopsis thaliana
  G1666,HLH/MYC domain coordinates 356-413
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 307 - DNA, 1179 bp, Arabidopsis thaliana
  G1669,family:Z-CO-like
atggtggtcgatgtagagagccgaaccgcgagcgtgacaggagagaagatggcggcgcgtggctgtgatgcgtgcatgaagagatcacgtgctagttggtactgtccagccgatgacgctttcctatgccaaagctgcgacgcctcgatccactcggctaaccatttagcgaaacggcacgaacgtgtccggttacaatcatcttcgccgacggagacggcagacaaaacgacgtcggtatggtacgaaggattcaggagaaaggcgagaacgcctaggagcaagagttgtgcgtttgagaagttgttgcaaatcgagtcaaacgatcctcttgttccggagcttggtggagacgaagatgatggctttttctcgttctcctccgtagaagaaaccgaggagagtctgaattgttgcgtgcctgttttcgatcctttctcagacatgctgattgatgatataaacggcttttgcttagttcctgatgaagtcaataacactactactaatggagaattaggagaagtcgagaaggcaatcatggacgatgaaggttttatggggttcgtgccattggatatggatcttgaggatctcactatggacgtggagagtttacttgaggaagaacaactttgcttgggattcaaggaaccaaacgatgttggagtcatcaaagaagagaataaagtagggtttgagattaattgtaaggatttgaagagggtgaaagatgaagatgaagaagaagaagaagccaagtgtgaaaatggaggatcaaaggatagtgatagagaagcatcaaatgataaagatagaaagacaagtttgtttctgagattagattatggagctgtgattagtgcttgggataatcacggttcgccgtggaaaaccggaatcaaaccggagtgcatgttgggagggaacacgtgtctgcctcatgttgtgggtgggtacgagaaattgatgtcgagcgacggatcggtgacacgtcagcaagggagagacggaggaggatcggacggggagagagaggcgagggttttgaggtacaaggagaagcggaggacgaggttgttctcaaagaaaataagatatgaggttcggaaacttaacgctgagcagagacctcgaatcaaaggtcgtttcgtgaagaggacgtcacttttgacgtga

SEQ ID NO: 308 - protein, 392 aa, Arabidopsis thaliana
  G1669,Z-CO-like domain coordinates NA
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 309 - DNA, 806 bp, Arabidopsis thaliana
  G167,family:MADS
caaatagttaaagaaaatatggggaggaaaaaactaaaattgaagagaatagagtccctaaaagagagaagtagcaaattttcaaaacgtaaaaaaggtctttttaaaaaggcagaagaagtagcattgttatgcgactcggatataatgttaattgttgtttctcccaccgagaagcctacagtttttaacactcgttctagatcattccatacaatccttgagaggttttgcatgctttcattacaagaacgggaagagaggagagcttacacaataaagacgctgaaaaaattggtgaacgagaacaataccgaaatatccactgaaaatgatcaattttcgcctgaaaataatcaactttcgcctgaaaatgatcaatttttgtctgaaatggatcaattttcgtctaaaaatcaatatttatctgaaagtgatgaagtgattcaggatgataataaggtcaccaaactgagagaactcaaggaattgtatgctgagaagatggtaattttgaggaactgggaaagcccgaataaagttacagatttgcaaggacttaatatcatggaagaatatttagtcaattctctcaaccatatcaaaaaaaccataaagattaagatccaagaagagcaacaaaactcttatttcatttagagatggagagtttatttgtacttagccgactgaagatcataggaaatcatgttctattttcttcaaacgtttcatatgtaatcattaattgaatttgaaattttgttttatattttttaatattaaatgttggatctcatttcttg

SEQ ID NO: 310 - protein, 213 aa, Arabidopsis thaliana
  G167,MADS domain coordinates 2-57
MGRKKLKLKRIESLKERSSKFSKRKKGLFKKAEEVALLCDSDIMLIVVSPTEKPTVFNTRSRSFHTILERFCMLSLQEREERRAYTIKTLKKLVNENNTEISTENDQFSPENNQLSPENDQFLSEMDQFSSKNQYLSESDEVIQDDNKVTKLRELKELYAEKMVILRNWESPNKVTDLQGLNIMEEYLVNSLNHIKKTIKIKIQEEQQNSYFI

SEQ ID NO: 311 - DNA, 743 bp, Arabidopsis thaliana
  G1670,family:NAC
atgcttgtaaaggtttgaaatttgatcaagttttgaagaagcaaattgaaaaagaaaagaaaagagaagacatggaggtggagaagaggattgtagtgaatggaggaatgaaattgccaataggatacagatttcacccaaccgagcaagagcttatccttcattacttgctcccaaaggcctttgcttctcctttgccttcctccatcatccctgtctttgacctcttcttctctcatcctcttagtttcccaggtctctttctctctctctctctctctctatgttccttctgtcaaagcctctatgtgtgtatatgtctcctcgttttcctcaactgttttttgttcaaaatggtctatcttatgtttgggtctagatccggggtgtctgatgctaaaactgaagaagttttgctttcaggggaccaaaaggagaagcagaggtacttcttttgcaagaagagagaagtgtcaagtaatgagcatagaatcaagatttcctctggtgatggttattggaaacctattggtaaagagagaccaatcattgcctgtggtaaaacatttgggattagaagaacacttgctttctatgaaacaaacaagtcttcttcttattgcaacaaaactagatggagcatgacagagtattgtcttgcgggatttgcgtcggctaaggtacacaataactactctagactactgtaagaaagacattggaacttgtgataataatgggtt

SEQ ID NO: 312 - protein, 212 aa, Arabidopsis thaliana
  G1670,NAC domain coordinates 15-198
MEVEKRIVVNGGMKLPIGYRFHPTEQELILHYLLPKAFASPLPSSIIPVFDLFFSHPLSFPGLFLSLSLSLCSFCQSLYVCICLLVFLNCFLFKMVYLMFGSRSGVSDAKTEEVLLSGDQKEKQRYFFCKKREVSSNEHRIKISSGDGYWKPIGKERPIIACGKTFGIRRTLAFYETNKSSSYCNKTRWSMTEYCLAGFASAKVHNNYSRLL

SEQ ID NO: 313 - DNA, 993 bp, Arabidopsis thaliana
  G168,family:MADS
atggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaa

SEQ ID NO: 314 - protein, 330 aa, Arabidopsis thaliana
  G168,MADS domain coordinates 1-57
MGMKKVKLSLIANEISRETSFMKRKNGIMKKLYELSTLCGVQACTLIYSPFIPVPEFLEMSPTARTRKMMNQETYLMERITKAKEQLQNLVGANQELQYRYDAKDLQDLLSCINLYLDQLNGRIEILKEHGDSLPSVSPFPTRIGVEETGDESSSDSPILATTGVVDTPNATNPRVLVADTTHFLDANATAVTAPFGFSNHIQYKNMNMSQDLHRPFQHLVPTNFCDFFQNQNMNQVQYQAPPNDMFNQIQREFYNINLNQKSNQYMNQQQPFMNPMVEQHMSHVGGRESIPFMDGNYYNYNQLPVVDHGSTSYMPSTTGVYDPYFNNNL

SEQ ID NO: 315 - DNA, 869 bp, Arabidopsis thaliana
  G1730,family:RING/C3H2C3
gcaatctacgaaactggtagcaatctgggggtttctctaatcatcaaccttcaaatgtcgtcaacaacatcaatagattcaataccagctactgctgttttccctagtgtttccatgcctgtcaccgtagttttgaccggtgttcttctctttgtaattttcgccggattcttctctcttttcttatggcagtttcttctgaatcgattatttactacttggaaccttcaacgaacaccttacggtgacctaatccatgtggccactccgcctgaaaatactggcctcgacccgtttatcatccggtcctttcctgtattccactattcatctgcaactaagaaaaatcatgggacggaatgcgctatttgcttgtcagagttttcagatgaagatacagttaggctcataacggtttgtcgtcatccctttcattcaaattgcattgatctttggtttgagttacacaagacttgtcctgtttgccggtgtgagttagatcctggcatgattggatctggaaggcttgaatcattccacaacacagtcacaattactattcaggacataaaccatgatgaggaaaatcctccaaccgctggttcaagcaaaaggctaatagaagcctcggcttggcgattctcgaggtcacattctactggacatttcatggttaagactacggatgctaatgtgaagtccaaaagaaggcattaccaaacaggaagctgtgtctcgttcgacgaacttactcggtatgaaggagcaggatggcaatggcttggtgattcatcacacattagcaggattgaagtatagtttactgaatttctgttacatcttcattattgtgttctttgtagcagtag

SEQ ID NO: 316 - protein, 254 aa, Arabidopsis thaliana
  G1730,RING/C3H2C3 domain coordinates 103-144
MSSTTSIDSIPATAVFPSVSMPVTVVLTGVLLFVIFAGFFSLFLWQFLLNRLFTTWNLQRTPYGDLIHVATPPENTGLDPFIIRSFPVFHYSSATKKNHGTECAICLSEFSDEDTVRLITVCRHPFHSNCIDLWFELHKTCPVCRCELDPGMIGSGRLESFHNTVTITIQDINHDEENPPTAGSSKRLIEASAWRFSRSHSTGHFMVKTTDANVKSKRRHYQTGSCVSFDELTRYEGAGWQWLGDSSHISRIEV

SEQ ID NO: 317 - DNA, 678 bp, Arabidopsis thaliana
  G1736,family:RING/C3H2C3
tgcttcaaggactgttgttcgctactcttgcttaattattactatagctggtgaaaatgggaggttgctgtagttcttcgaggaagtcacatcttgttggaacacctgtttactattattgtccagaatcttttgaagagcttgtcccttcaggaacccgtgctggtgtgggatcagcattcaccacaggcctcttggttgatataggtttggagacatctatacctgacaccttttgtgctcctgctcctcttccatatgatttgcttttggggcgaccacaatgcacagattctgagtccatcaaaggaaggatgagtggaagcagttttgaaacgctagcgacgtgtgaagatcttggggaatcagactgtaaaactctagccagctcagtcattctttcaccgaggaaatcagatttctcgaaacatcaaggattgaagatattggttgatgaagaggaggactgttgtcctatttgctttgaagattatgatgttgagaatccaagactaacgacaaagtgtgagcacgaatttcacctctcttgtcttctggagtggattgaaagaagcgatagatgcccaatatgtgataaggaagttgtgtttgatgatcgcttgaactagcatcattactatcccctggcttgaaagtttgaaggtgtggcgctttgtt

SEQ ID NO: 318 - protein, 190 aa, Arabidopsis thaliana
  G1736,RING/C3H2C3 domain coordinates 139-179
MGGCCSSSRKSHLVGTPVYYYCPESFEELVPSGTRAGVGSAFTTGLLVDIGLETSIPDTFCAPAPLPYDLLLGRPQCTDSESIKGRMSGSSFETLATCEDLGESDCKTLASSVILSPRKSDFSKHQGLKILVDEEEDCCPICFEDYDVENPRLTTKCEHEFHLSCLLEWIERSDRCPICDKEVVFDDRLN

SEQ ID NO: 319 - DNA, 1136 bp, Arabidopsis thaliana
  G1750,family:AP2
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 320 - protein, 335 aa, Arabidopsis thaliana
  G1750,AP2 domain coordinates 115-177
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 321 - DNA, 1123 bp, Arabidopsis thaliana
  G1751,family:AP2
aaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaaggcaagtgcaagcgccagtgtgagcgccacagattcagttgaagcagagcaatggaacggaggaggaggggattgcaatatggaggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaa

SEQ ID NO: 322 - protein, 268 aa, Arabidopsis thaliana
  G1751,AP2 domain coordinates 133-200
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 323 - DNA, 933 bp, Arabidopsis thaliana
  G1752,family:AP2
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 324 - protein, 243 aa, Arabidopsis thaliana
  G1752,AP2 domain coordinates 83-151
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 325 - DNA, 773 bp, Arabidopsis thaliana
  G1755,family:AP2
acctttttttttctctgctaacgaaaaaagccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaagtaaacaaaaaaaaaaaaaaaaa

SEQ ID NO: 326 - protein, 164 aa, Arabidopsis thaliana
  G1755,AP2 domain coordinates 71-133
MPSASEIVDRKRKSRGTRDVAEILRKWREYNEQTEADSCIDGGGSKPIRKAPPKRSRKGCMKGKGGPENGICDYTGVRQRTWGKWVAEIREPGRGAKLWLGTFSSSYEAALAYDEASKAIYGQSARLNLPLLPLCQARLLHFLMNLKFVHVRIQMQDLVLVRSD

SEQ ID NO: 327 - DNA, 1432 bp, Arabidopsis thaliana
  misc_feature (1419)..(1419): n is a, c, g, or t
  G1757,family:WRKY
atcaccaatcctataacactctcattctcatcatatcattcttcaatctatataacccattcttaattatactcaacacacattatatttttctgatcatatcattctttcagtccatctatataaccaattcttgatttatacttaaaacacacattatacatctttctcatcatagtttgtatcaatttcctagagtaaactacctaaaggaaaaaaaaaatctattttgggaatcatatactaaaaatggaaggaagagatatgttaagttgggagcaaaagacattgctaagcgagcttatcaatggatttgatgcggccaaaaagcttcaggcacgacttagagaagctccgtcgccgtcgtcatcattttcatcaccggcgacggctgttgctgagactaacgagattctggtgaagcagatagtttcttcctacgagagatctcttcttctgctaaactggtcatcctcaccgagcgtacaacttattccgacgccggttactgtagtcccggtggcaaatcccggcagtgttccagaatctccggcatcgataaacggaagtccgagaagtgaagagtttgccgatggaggaggttctagcgagagtcatcatcgccaagattacattttcaattcaaagaaaagaaagatgttaccaaagtggtcagaaaaagtgagaataagcccagagagaggcttagaaggacctcaagatgatgtctttagctggagaaaatatggtcaaaaagacattttaggcgccaaattcccaaggagttattacagatgcacacatcgtagcacacaaaactgttgggcaacgaaacaagtccagagatcagacggggatgctacggttttcgaagtgacgtacagaggaacacacacttgttcgcaggcgatcacaagaacaccaccattagcctcgccggagaagcgacaagacaccagagtcaaaccagccattacccaaaagccaaaggatattctcgagagtcttaaatccaacttaaccgttcgaaccgatgggcttgatgatggtaaagacgttttctcgttccctgatacgccgccgttttacaattacggaactatcaacggcgagttcggccacgtggagagttctccgatcttcgacgttgttgactggttcaatccaacggtcgagattgacacaactttccccgcgtttttacacgagtcgatttattattaattaaaatttgtaacagagaaatagatagtaactagtaagtaatgatcagcgagagttaaaacataaaagtacttagagtaatctaacgatgcataataaggaatgttcaacaggacttgaacatgatttcaatactaagagagatttatctagctactggtagtagccgcagacttcttgttgtagcttcacttnctttttgttgctt

SEQ ID NO: 328 - protein, 324 aa, Arabidopsis thaliana
  G1757,WRKY domain coordinates 158-218
MEGRDMLSWEQKTLLSELINGFDAAKKLQARLREAPSPSSSFSSPATAVAETNEILVKQIVSSYERSLLLLNWSSSPSVQLIPTPVTVVPVANPGSVPESPASINGSPRSEEFADGGGSSESHHRQDYIFNSKKRKMLPKWSEKVRISPERGLEGPQDDVFSWRKYGQKDILGAKFPRSYYRCTHRSTQNCWATKQVQRSDGDATVFEVTYRGTHTCSQAITRTPPLASPEKRQDTRVKPAITQKPKDILESLKSNLTVRTDGLDDGKDVFSFPDTPPFYNYGTINGEFGHVESSPIFDVVDWFNPTVEIDTTFPAFLHESIYY

SEQ ID NO: 329 - DNA, 896 bp, Arabidopsis thaliana
  G1758,family:WRKY
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 330 - protein, 202 aa, Arabidopsis thaliana
  G1758,WRKY domain coordinates 109-165
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 331 - DNA, 943 bp, Arabidopsis thaliana
  G1759,family:MADS
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 332 - protein, 196 aa, Arabidopsis thaliana
  G1759,MADS domain coordinates 2-57
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 333 - DNA, 1038 bp, Arabidopsis thaliana
  G1760,family:MADS
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 334 - protein, 228 aa, Arabidopsis thaliana
  G1760,MADS domain coordinates 2-57
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 335 - DNA, 1135 bp, Arabidopsis thaliana
  G1763,family:AP2
gtacatttttttttgtatttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacccattttcttcttcttcttactataatcctcatgcatctttcttcccttcacattccacaaccacttacccggatatttattctggatccatgacctatccatcttcattcgggtcggatcttcaacaacccgaaaactaccaatctcagttccattaccaaaacactatcacttacactcaccaagacaacaacacttgcatgctcaacttcattgagccgagccaaccggattttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgacgttggcgaatacggacctattcaagctgccgttgacgccaagctagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaacttgtttgtattttcttttaaactttagggttattagctgtgcgtaaaatttgtaatttagcattttgtatgaatgtaatgcaagtgtgtaaattatggacagctcaagcttttttgttaaaa

SEQ ID NO: 336 - protein, 314 aa, Arabidopsis thaliana
  G1763,AP2 domain coordinates 140-207
MADLFGGGHGGELMEALQPFYKSASTSASNPAFASSNDAFASAPNDPFSSSSYYNPHASFFPSHSTTTYPDIYSGSMTYPSSFGSDLQQPENYQSQFHYQNTITYTHQDNNTCMLNFIEPSQPDFMTQPGPSSGSVSKPAKLYRGVRQRHWGKWVAEIRLPRNRTRLWLGTFDTAEEAALAYDRAAFKLRGDSARLNFPALRYQTGSSPSDVGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 337 - DNA, 920 bp, Arabidopsis thaliana
  G1765,family:NAC
aagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacg

SEQ ID NO: 338 - protein, 275 aa, Arabidopsis thaliana
  G1765,NAC domain coordinates 20-140
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 339 - DNA, 1596 bp, Arabidopsis thaliana
  G1767,family:SCR
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 340 - protein, 531 aa, Arabidopsis thaliana
  G1767,SCR domain coordinates 225-290,355-450,453-528
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 341 - DNA, 2026 bp, Arabidopsis thaliana
  G1772,family:RING/C3HC4
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggtcatcactcaggaatcgcttctagcagcacagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttgttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtg

SEQ ID NO: 342 - protein, 597 aa, Arabidopsis thaliana
  G1772,RING/C3HC4 domain coordinates 123-176
MDDYFSAEEEACYYSSDQDSLDGIDNEESELQPLSSKRSNTQVITQESLLAAQREDLLRVMELLSIKEHHARTLLIHYQWDVEKLFAVFVEKGKDSLFSGAGVTVFDYQYGNSSFPQSSQMSCDVCMEDLPGDHMTRMDCGHCFCNNCWTEHFTVQINEGQSKRIRCMAHQCNAICDEDIVRSLVSKKRPDLAAKFDRYLLESYIEDNRMVKWCPSTPHCGNAIRAEDDKLCEVECSCGLQFCFSCLCQAHSPCSCLMWELWRKKCRDESETINWITVHTKLCPKCYKPVEKNGGCNLVRCICGQCFCWLCGGATGSDHTYRSIAGHSCGRYQDDKEKQMERAKRDLNRYTHYHHRYKAHTDSSKLEDKLRDTIHEKVSKSEKRELKLKDFSWVTNGLDRLFRSRRVLSYSYAFAYYMFGEEMFKDEMTPEEREIKKNLFEDQQQQLESNVEKLSQFLEEPFDEFSNDKVMAIRIQIINLSVAVDTLCKKMYECIENDLLGSLQLGIHNISPYRSKGIEQAAQFYASWNSKDADKFQPLDSGTSGVTSRPEQASGSRSSEDTICSSSQKRPKKEGSFLNNKVTLLDLNLPADFVDQN

SEQ ID NO: 343 - DNA, 1224 bp, Arabidopsis thaliana
  G1774,family:RING/C3HC4
atggacttttcagatgatgacatgattgataacaaatcaggggaggagaattacagctatggtggtggtaacgaatccgatgactacaacgatgtggtagacacaattattccatcggagaaaagttacgtgattctcaaggaagaagacattctcaagcttcaaagagacgatatcgaacgagtttcatcgattctttctctaagccaagtggaagtgattgttctgcttcttcactataactggtgtgttagtaaagtcgaagacgaatggtttacggacgaagaaagaatccgtaaagccgttggtttattgaaggagcctgtcgttgacttcaatggtggagaaaaagacaaaaaatgtagaaaagtgaatatccaatgtggaatttgctttgaatcatacactcgagaggaaattgcaagggtttcttgtggtcatccttattgcaagacttgctgggctggttacatcactacaaaaatcgaagacggtccgggatgtttaagggttaaatgtcctgagccttcttgttccgctgctgttggtaaagatatgatcgaggatgttactgagacaaaagttaacgagaagtattctagatatattcttaggtcttatgtagaagatgggaagaagattaaatggtgtccatcaccgggatgcggatacgcggttgaattcggtggaagtgaaagtagtagttacgatgtttcttgtttgtgttcgtataggttttgctggaattgcagtgaagatgctcacagtcctgtggattgtgacacggtttcaaaatggatattcaagaaccaggatgagtcggagaacaagaattggatgcttgcgaattcaaagccttgtcctgaatgcaagcgtcctatcgagaagaacgatggatgtaaccatatgacatgttcagctccgtgtggacatgagttttgttggatttgtcttaaagcatatcgtcgtcacagcggtgcttgcaataggtttgttgtggagcaggcagaaagtaagagagcattgcttcagagtgaaatcaaaagatacacgcattattatgtaagatgggcagaaaatcaatcgtcgaggctaaaggctatgagagatctggagaagttgcaatcggtgcagcttaaggagcttagtgacaatcagtgcacgtctgaaactcagcttcaattcaccgtagatgcatggcttcaggtcagtaaaagtatttaa

SEQ ID NO: 344 - protein, 407 aa, Arabidopsis thaliana
  G1774,RING/C3HC4 domain coordinates 128-242
MDFSDDDMIDNKSGEENYSYGGGNESDDYNDVVDTIIPSEKSYVILKEEDILKLQRDDIERVSSILSLSQVEVIVLLLHYNWCVSKVEDEWFTDEERIRKAVGLLKEPVVDFNGGEKDKKCRKVNIQCGICFESYTREEIARVSCGHPYCKTCWAGYITTKIEDGPGCLRVKCPEPSCSAAVGKDMIEDVTETKVNEKYSRYILRSYVEDGKKIKWCPSPGCGYAVEFGGSESSSYDVSCLCSYRFCWNCSEDAHSPVDCDTVSKWIFKNQDESENKNWMLANSKPCPECKRPIEKNDGCNHMTCSAPCGHEFCWICLKAYRRHSGACNRFVVEQAESKRALLQSEIKRYTHYYVRWAENQSSRLKAMRDLEKLQSVQLKELSDNQCTSETQLQFTVDAWLQVSKSI

SEQ ID NO: 345 - DNA, 1338 bp, Arabidopsis thaliana
  G1775,family:RING/C3HC4
atggattattcagatgatgacatgatcgataacgaatcaggggaggagaataacagcgatggtggtggtaatgaatcctacaactacaacgctgcggtagacacaattattctatctgagaaaagttacgtgattatcaaggaagaagagattctgaagcttcaaagagacgacatcgaacgagtttccacgattctctttctaagccaagtggaagcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagtgtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatgcgcggttgaatttggtgaaagtagtggttacgatgttgcttgtttgtgttcgtataggttttgctggaattgcagtgaagatgctcacagtcctgtggattgtgaaacagtgtcaaaatggatattcaagaaccaagatgagtcggagaacaagaattggatactagcgaattcgaagccatgtcctaaatgcaaacgtcctatcgagaagagccatggatgtaaccatatgacatgctcagcgtcgtgtggccatcgtttttgttggatttgtggtaaatcatatagtgatcactatgcttgcaacaattatgttgaagatgctgatcacgataagagaacattgcttcagagtgaaatcaaaagatacacgcattattatgtaagatgggtagaaaatcaatcgtcgaggcttaaggctatgagtgatctggagaaattccaatcggtgcagctaaagcagcttagtgacaatcagtgcaaaccaaaaattgatctccaattcattgtagatgcatggcttcaggttagtaacattacgaaactgtatattaaaaaaagaattgtatgtgcaatgttacacagagaatgtaggaatgaccatcgtagaaatttgaaaaaacgatttcatgattatacttatatattaatcttgaactatgaatggatcactaaaaagtgtgattag

SEQ ID NO: 346 - protein, 445 aa, Arabidopsis thaliana
  G1775,RING/C3HC4 domain coordinates 121-241
MDYSDDDMIDNESGEENNSDGGGNESYNYNAAVDTIILSEKSYVIIKEEEILKLQRDDIERVSTILFLSQVEAIVLLLHYHWCVSKLEDEWFTDEERIRKTVGILKEPVVDVNGTEVDIQCGICFESYTRKEIASVSCGHPYCKTCWTGYITTKIEDGPGCLRVKCPEPSCYAVVGQDMIDEVTEKKDKDKYYRYFLRSYVEDGKKMKWCPSPGCECAVEFGESSGYDVACLCSYRFCWNCSEDAHSPVDCETVSKWIFKNQDESENKNWILANSKPCPKCKRPIEKSHGCNHMTCSASCGHRFCWICGKSYSDHYACNNYVEDADHDKRTLLQSEIKRYTHYYVRWVENQSSRLKAMSDLEKFQSVQLKQLSDNQCKPKIDLQFIVDAWLQVSNITKLYIKKRIVCAMLHRECRNDHRRNLKKRFHDYTYILILNYEWITKKCD

SEQ ID NO: 347 - DNA, 2006 bp, Arabidopsis thaliana
  G1777,family:RING/C3HC4
ctcgtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttca

SEQ ID NO: 348 - protein, 593 aa, Arabidopsis thaliana
  G1777,RING/C3HC4 domain coordinates 124-247
MDDNLSGEEEDYYYSSDQESLNGIDNDESVSIPVSSRSNTVKVITKESLLAAQREDLRRVMELLSVKEHHARTLLIHYRWDVEKLFAVLVEKGKDSLFSGAGVTLLENQSCDSSVSGSSSMMSCDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSCSSQAHSPCSCVMWELWRKKCFDESETVNWITVHTKPCPKCHKPVEKNGGCNLVTCLCRQSFCWLCGEATGRDHTWARISGHSCGRFQEDKEKQMERAKRDLKRYMHYHNRYKAHIDSSKLEAKLSNNISKKVSISEKRELQLKDFSWATNGLHRLFRSRRVLSYSYPFAFYMFGDELFKDEMSSEEREIKQNLFEDQQQQLEANVEKLSKFLEEPFDQFADDKVMQIRIQVINLSVAVDTLCENMYECIENDLLGSLQLGIHNITPYRSNGIERASDFYSSQNSKEAVGQSSDCGWTSRLDQALESGKSEDTSCSSGKRARIDESYRNSQTTLLDLNLPAEAIERK

SEQ ID NO: 349 - DNA, 757 bp, Arabidopsis thaliana
  G1781,family:CAAT
cgtcgaccagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgcttgcgggccgctctaggcgggaaaagcccgaat

SEQ ID NO: 350 - protein, 215 aa, Arabidopsis thaliana
  G1781,CAAT domain coordinates 35-124
MTEESPEEDHGSPGVAETNPGSPSSKTNNNNNNNKEQDRFLPIANVGRIMKKVLPGNGKISKDAKETVQECVSEFISFVTGEASDKCQREKRKTINGDDIIWAITTLGFEDYVAPLKVYLCKYRDTEGEKVNSPKQQQQRQQQQQIQQQNHHNYQFQEQDQNNNNMSCTSYISHHHPSPFLPVDHQPFPNIAFSPKSLQKQFPQQHDNNIDSIHW

SEQ ID NO: 351 - DNA, 1170 bp, Arabidopsis thaliana
  G1786,family:MYB-(R1)R2R3
atgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctag

SEQ ID NO: 352 - protein, 389 aa, Arabidopsis thaliana
  G1786,MYB-(R1)R2R3 domain coordinates NA
MIVYGGGASEDGEGGGVVLKKGPWTVAEDETLAAYVREYGEGNWNSVQKKTWLARCGKSCRLRWANHLRPNLRKGSFTPEEERLIIQLHSQLGNKWARMAAQLPGRTDNEIKNYWNTRLKRFQRQGLPLYPPEYSQNNHQQQMYPQQPSSPLPSQTPASSFTFPLLQPPSLCPKRCYNTAFSPKASYISSPTNFLVSSPTFLHTHSSLSSYQSTNPVYSMKHELSSNQIPYSASLGVYQVSKFSDNGDCNQNLNTGLHTNTCQLLEDLMEEAEALADSFRAPKRRQIMAALEDNNNNNNFFSGGFGHRVSSNSLCSLQGLTPKEDESLQMNTMQDEDITKLLDWGSESEEISNGQSSVITTENNLVLDDHQFAFLFPVDDDTNNLPGIC

SEQ ID NO: 353 - DNA, 578 bp, Arabidopsis thaliana
  G1789,family:MYB-related
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 354 - protein, 101 aa, Arabidopsis thaliana
  G1789,MYB-related domain coordinates 12-62
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 355 - DNA, 724 bp, Arabidopsis thaliana
  G179,family:WRKY
gtctttctctccctcccctccttggcttttttcaagttcccaccataaacgcagagggagttaagaaatggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgccgttgataaaccctctgataatttccaccacatcttgacacaaatgcacatcttccctcccttttgcttgaaggaatgattagaggaattggattgtaatatttactttcccaaaaacgttgggctcacaccatcagacctttacttttaaactagcagcaactcacatatctcaaaaatactaatccttatctttgtctttatgggacctttgaatccatctgctttggtgtcttagtctcggctgccctgtaatcgaaagtatattcatcatcaaattaccaaacataaa

SEQ ID NO: 356 - protein, 147 aa, Arabidopsis thaliana
  G179,WRKY domain coordinates 65-121
MEDRRCDVLFPCSSSVDPRLTEFHGVDNSAQPTTSSEEKPRSKKKKKEREARYAFQTRSQVDILDDGYRWRKYGQKAVKNNPFPRSYYKCTEEGCRVKKQVQRQWGDEGVVVTTYQGVHTHAVDKPSDNFHHILTQMHIFPPFCLKE

SEQ ID NO: 357 - DNA, 615 bp, Arabidopsis thaliana
  G1797,family:MADS
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataa

SEQ ID NO: 358 - protein, 202 aa, Arabidopsis thaliana
  G1797,MADS domain coordinates 1-57
MVRGKIEIKKIENVTSRQVTFSKRRSGLFKKAHELSVLCDAQVAAMIFSQKGRLYEFASSDIRNTIKRYAEYKREYFVAETHPIEQYVQGLKKEMVTMVKKIEVLEVHNRKMMGQSLDSCSVKELSEIATQIEKSLHMVRLRKAKLYEDELQKLKAKERELKDERVRLSLKVGERPMGMPSGSKEKEDVETDLFIGFLKNRP

SEQ ID NO: 359 - DNA, 1107 bp, Arabidopsis thaliana
  G1800,family:AP2
ccattatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaatgaagcatgttcattttttcgctaaaaaaaaaaaaaaaaaaaaaaa

SEQ ID NO: 360 - protein, 277 aa, Arabidopsis thaliana
  G1800,AP2 domain coordinates 25-92
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 361 - DNA, 1716 bp, Arabidopsis thaliana
  G1804,family:bZIP
tatctctctctttctcaaaacctttcagtcaaaattctccggcggcttttaaactatgtgaaggaggagaacctccataacaagaagcggattctctcagttttccggcggcggaggaacacaaagccaccggtttttagacacacagatttcattttcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagcatatacagtggaattggaagctgaacttaaccagttgaaagaagagaatgcgcagctaaaacatgcattggcggagttggagaggaagaggaagcaacagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgaggaatgaggttatagaatctttatactttgatgttttctgtgttggtaggaggaacaccatctgatctgctttactagtgttccctgtgaacaaagaaagtgattctgtgtttcaacatcatcaatctttggaaa

SEQ ID NO: 362 - protein, 442 aa, Arabidopsis thaliana
  G1804,bZIP domain coordinates 357-407
MVTRETKLTSEREVESSMAQARHNGGGGGENHPFTSLGRQSSIYSLTLDEFQHALCENGKNFGSMNMDEFLVSIWNAEENNNNQQQAAAAAGSHSVPANHNGFNNNNNNGGEGGVGVFSGGSRGNEDANNKRGIANESSLPRQGSLTLPAPLCRKTVDEVWSEIHRGGGSGNGGDSNGRSSSSNGQNNAQNGGETAARQPTFGEMTLEDFLVKAGVVREHPTNPKPNPNPNQNQNPSSVIPAAAQQQLYGVFQGTGDPSFPGQAMGVGDPSGYAKRTGGGGYQQAPPVQAGVCYGGGVGFGAGGQQMGMVGPLSPVSSDGLGHGQVDNIGGQYGVDMGGLRGRKRVVDGPVEKVVERRQRRMIKNRESAARSRARKQAYTVELEAELNQLKEENAQLKHALAELERKRKQQYFESLKSRAQPKLPKSNGRLRTLMRNPSCPL

SEQ ID NO: 363 - DNA, 1356 bp, Arabidopsis thaliana
  G1806,family:bZIP
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 364 - protein, 451 aa, Arabidopsis thaliana
  G1806,bZIP domain coordinates 165-225
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 365 - DNA, 2000 bp, Arabidopsis thaliana
  G1807,family:bZIP
aggttagttctacacaaagcttgatcttttaggggttttctctagttattggagagtggtgagaattagaaactgcattatccgatctaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcagcgcgatatgatggggttgacaaatcagaacaatgagcttaagttccggcttcaagcaatggagcaacaagcgcgtcttcgcgatgctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattgattgagcttcagacaaaaa

SEQ ID NO: 366 - protein, 553 aa, Arabidopsis thaliana
  G1807,bZIP domain coordinates 249-297
MGDTEKCNSDMIQRLHSSFGTTSSSIPKNPISQLDLNPNFIRSSAPQFSKPFSDSGKRIGVPPSHPNLIPPTSPFSQIPTTRQPGSHNFNPGGANHSRSMSQPNSFFSFDSLPPLSPSPFRDHDVSMEDRDSGVFNSNHSLPPSPFTRCNSTSSSSLRVGESLPPRKSHRRSNSDIPSGFNSMPLIPPRPLERSFSGGECADWSKSNPFVKKESSCEREGVGEREAMDDLFSAYMNLENIDVLNSSEADDSKNGNENRDDMESSRASGTKTNGSDTEGESSSVNESANNNMNSSGEKRESVKRRAAGGDIAPTTRHYRSVSVDSCFMEKLSFGDESLKPPPSPGSMSRKVSPTNSVDGNSGAAFSIEFNNGEFTAAEMKKIMANDKLAEMAMSDPKRVKRNDPLFRILANRQSAARSKERKMRYIVELEHKVQTLQTEATTLSAQLTLLQRDMMGLTNQNNELKFRLQAMEQQARLRDALNEALNGEVQRLKLAIGESSQNESERSKMQSLNAEMFQQLNISQLRQQPQQMQQQSHQQNHQNGTMATKSESNE

SEQ ID NO: 367 - DNA, 977 bp, Arabidopsis thaliana
  G1808,family:bZIP
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 368 - protein, 248 aa, Arabidopsis thaliana
  G1808,bZIP domain coordinates 140-200
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 369 - DNA, 604 bp, Arabidopsis thaliana
  G1809,family:bZIP
ctctctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttctttcttttttggttttggtttgtatacactttttgttcgaataacattcactttgagcat

SEQ ID NO: 370 - protein, 149 aa, Arabidopsis thaliana
  G1809,bZIP domain coordinates 23-35,68-147
MSLQRPNGNSSSSSSHKKHKTEESDEELLMVPDMEAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 371 - DNA, 1087 bp, Arabidopsis thaliana
  G1811,family:ABI3/VP-1
aaaggagcattggtatctcaaacaatatttgccctttctctatctctctctcatcactatttgccatctctttctctctccctctctttcaaatgtcaataaaccaatactcaagcgatttccactaccattctctcatgtggcaacaacagcagcaacaacaacaacaccaaaacgacgtcgtggaagaaaaagaagctcttttcgagaaacccttaaccccaagtgacgtcggaaaactcaaccgcctcgtcatcccaaaacagcacgccgagagatacttcccactagcggccgccgccgcagacgccgtggagaaaggacttctcctctgctttgaggacgaggaaggtaaaccatggagattcagatactcgtactggaacagtagccagagttatgtcttgaccaaaggctggagcagatacgtcaaggagaagcaccttgacgccggagacgtcgttctcttccatcgacaccgttcagacggcggaagattcttcattggctggagaagacgcggtgactcttcttcctcctccgactcttatcgccatgttcaatccaatgcctcgctccaatattatcctcatgcaggggctcaagcggtggagagccaaagaggcaactcgaagacattaagactgttcggagtgaacatggagtgccagctagattcggactggtccgagccatccacacctgacggttctaacacatatacaaccaatcacgaccagtttcatttctaccctcaacaacaacactatcctcctccgtactacatggacataagtttcacaggagatatgaaccggacgagctagaagcccacaaggattaaaaaaaagcttcacatctggtcctgttatgttgtcatagatgttgattccttaattttacacaagcttcattttgcattatttaaagtaaaatcgtattttgattcttctttaaatctctctcaattttcactctcttcctttttcttcttatgtattagattcttttacatagctaacacttgtatagagaattcaaagttctggctattttcgaaagttatcttttctcttaaaaaaaaaaa

SEQ ID NO: 372 - protein, 244 aa, Arabidopsis thaliana
  G1811,ABI3/VP-1 domain coordinates 34-128
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 373 - DNA, 1563 bp, Arabidopsis thaliana
  G1812,family:PCOMB
aaaggtgagttgtgtgttgtgtcaggtccaaaataaaagtttgtcgtgaggtcaaaatctacggttacagtaattttaataacctgtgaatctgtgtctaatcgaaaattacaaaacaccagttgttgttgcatgagagacttgtgagcttagattagtgtgcgagagtcagacagagagagagatttcgaatatcgaatgtcgaagataaccttagggaacgagtcaatagttgggtctttgactccatcgaataagaaatcgtacaaagtgacgaataggattcaggaagggaagaaacctttgtatgctgttgttttcaacttccttgatgctcgtttcttcgatgtcttcgttaccgctggtggaaatcggattactctgtacaattgtctcggagatggtgccatatcagcattgcaatcctatgctgatgaagataaggaagagtcgttttacacggtaagttgggcgtgtggcgttaatgggaacccatatgttgcggctggaggagtaaaaggtataatccgagtcattgacgtcaacagtgaaacgattcataagagtcttgtgggtcatggagattcagtgaacgaaatcaggacacaacctttaaaacctcaacttgtgattactgctagcaaggatgaatctgttcgtttgtggaatgttgaaactgggatatgtattttgatatttgctggagctggaggtcatcgctatgaagttctaagtgtggattttcatccgtctgatatttaccgctttgctagttgtggtatggacaccactattaaaatatggtcaatgaaagagttttggacgtacgtcgagaagtcattcacatggactgatgatccatcaaaattccccacaaaatttgtccaattccctgtatttacagcttccattcatacaaattatgtagattgtaaccgttggtttggtgattttatcctctcaaagagtgtggacaacgagatcctgttgtgggaaccacaactgaaagagaattctcctggcgagggagcttcagatgttctattaagatacccggttccaatgtgtgatatttggtttatcaagttttcttgtgacctccatttaagttctgttgcgataggtaatcaggaaggaaaggtttatgtctgggatttgaaaagttgccctcctgttttgattacaaagttatcacacaatcaatcaaagtctgtaatcaggcaaacagccatgtctgtcgatggaagcacgattcttgcttgctgcgaggacgggactatatggcgctgggacgtgattaccaagtagcggtctgagtcttgtaggaattgatgaattaggagtgcgaagaaatgagatatccattcttttattgtaattctgatcatgttgctactccctgagaccttgagatgctctttgtagccttgttaacgtccacccttgtaccacagtgtataccctttctggagattttgtcttattctcttagttcaatacacaaggctgtatcctggagctttattgcaggaaccactctctttcataagctttctagtattc

SEQ ID NO: 374 - protein, 369 aa, Arabidopsis thaliana
  G1812,PCOMB domain coordinates 32-365
MSKITLGNESIVGSLTPSNKKSYKVTNRIQEGKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWDVITK

SEQ ID NO: 375 - DNA, 639 bp, Arabidopsis thaliana
  G1819,family:CAAT
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattga

SEQ ID NO: 376 - protein, 212 aa, Arabidopsis thaliana
  G1819,CAAT domain coordinates 52-148
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 377 - DNA, 734 bp, Arabidopsis thaliana
  G1821,family:CAAT
atggaacgtggaggcttccatggctaccgcaagctgtccgtgaacaacaccactccttctccaccaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctga

SEQ ID NO: 378 - protein, 234 aa, Arabidopsis thaliana
  G1821,CAAT domain coordinates 57-146
MERGGFHGYRKLSVNNTTPSPPGLAANFLMAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 379 - DNA, 1662 bp, Arabidopsis thaliana
  G1824,family:GARP
gttaagggagaagaaagagacttactttggatatcaaaacatgtcttgctctctattctaattaagtctagcctatctacaacatacataaacctctatctacgattatatttggatctacaagtgaagattgatcgatgttagctctgtctccggcgacaagagatggttgcgacggagcgtcagagtttcttgatacgtcgtgtggattcacgattataaacccggaggaggaggaggagtttccggatttcgctgaccacggtgatcttcttgacatcattgacttcgacgatatattcggtgtggccggagatgtgcttcctgacttggagatcgaccctgagatcttatccggggatttctccaatcacatgaacgcttcttcaacgattactacgacgtcggataagactgatagtcaaggggagactactaagggtagttcggggaaaggtgaagaagtcgtaagcaaaagagacgatgttgcggcggagacggtgacttatgacggtgacagtgaccggaaaaggaagtattcctcttcagcttcttccaagaacaatcggatcagtaacaacgaagggaagagaaaggtgaaggtggattggacaccagagctacacaggagattcgtggaggcagtggaacagttaggagtggacaaagctgttccttctcgaattctggagcttatgggagtccattgtctcactcgtcacaacgttgctagtcacctccaaaaatataggtctcatcggaaacatttgctagctcgtgaggccgaagcggctaattggacacgcaaaaggcatatctatggagtagacaccggtgctaatcttaatggtcggactaaaaatggatggcttgcaccggcacccactctcgggtttccaccaccaccacccgtggctgttgcaccgccacctgtccaccaccatcattttaggcccctgcatgtgtggggacatcccacggttgatcagtccattatgccgcatgtgtggcccaaacacttacctccgccttctaccgccatgcctaatccgccgttttgggtctccgattctccctattggcatccaatgcataacgggacgactccgtatttaccgaccgtagctacgagatttagagcaccgccagttgccggaatcccgcatgctctgccgccgcatcacacgatgtacaaaccaaatcttggatttggtggtgctcgtcctccggtagacttacatccgtcaaaagagagcgtggatgcagccataggagatgtattgacgaggccatggctgccacttccgttgggattaaatccgccggctgttgacggtgttatgacagagcttcaccgtcacggtgtctctgaggttcctccgaccgcgtcttgtgcctgaaacgcacaagatccgtaggcaagcgagaaccaaacaaaaattcgacgacatgtctttcaattattgtacttttatttttccaagggttgtttttgttttgacccttgttgtgttaagagttactctttacttaatcgtcccatgtgactaataaggagacccttttcatatgtatctagggtgctaagtacactctagctctattaacgcaaataaattacctatattttctctaaaaaaaaaaaaaaaaaaaaaaaaaaaa

SEQ ID NO: 380 - protein, 420 aa, Arabidopsis thaliana
  G1824,GARP domain coordinates 158-205
MLALSPATRDGCDGASEFLDTSCGFTIINPEEEEEFPDFADHGDLLDIIDFDDIFGVAGDVLPDLEIDPEILSGDFSNHMNASSTITTTSDKTDSQGETTKGSSGKGEEVVSKRDDVAAETVTYDGDSDRKRKYSSSASSKNNRISNNEGKRKVKVDWTPELHRRFVEAVEQLGVDKAVPSRILELMGVHCLTRHNVASHLQKYRSHRKHLLAREAEAANWTRKRHIYGVDTGANLNGRTKNGWLAPAPTLGFPPPPPVAVAPPPVHHHHFRPLHVWGHPTVDQSIMPHVWPKHLPPPSTAMPNPPFWVSDSPYWHPMHNGTTPYLPTVATRFRAPPVAGIPHALPPHHTMYKPNLGFGGARPPVDLHPSKESVDAAIGDVLTRPWLPLPLGLNPPAVDGVMTELHRHGVSEVPPTASCA

SEQ ID NO: 381 - DNA, 668 bp, Arabidopsis thaliana
  G1836,family:CAAT
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 382 - protein, 187 aa, Arabidopsis thaliana
  G1836,CAAT domain coordinates 24-110
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 383 - DNA, 1941 bp, Arabidopsis thaliana
  G1838,family:AP2
ttccttggcattctctttagaactttcgtacaaaatgcaaaacctgaacctctaaagctaaaaaaaaagattagagactgtaactgcttttatcagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagacttctattcaccgcactaaccgatgacccgaggcttatcttcttgattctggctataaggatgaatctttcaagttccttttttaactgtaggctaagacagaagtagaggggagaaaagttgaagaatctgaaacttttggggtcaattttgtattaatgtttttcttttgtcaagggtggattatcggttttattacttattttttgaatgtaatcggcctataacggtataactctgtttccatttatgaatatttttctcaaattgaaaaaaaaaaaaaaaaaa

SEQ ID NO: 384 - protein, 498 aa, Arabidopsis thaliana
  G1838,AP2 domain coordinates 230-304,330-400
MAPPMTNCLTFSLSPMEMLKSTDQSHFSSSYDDSSTPYLIDNFYAFKEEAEIEAAAASMADSTTLSTFFDHSQTQIPKLEDFLGDSFVRYSDNQTETQDSSSLTPFYDPRHRTVAEGVTGFFSDHHQPDFKTINSGPEIFDDSTTSNIGGTHLSSHVVESSTTAKLGFNGDCTTTGGVLSLGVNNTSDQPLSCNNGERGGNSNKKKTVSKKETSDDSKKKIVETLGQRTSIYRGVTRHRWTGRYEAHLWDNSCRREGQARKGRQVYLGGYDKEDRAARAYDLAALKYWGSTATTNFPVSSYSKELEEMNHMTKQEFIASLRRKSSGFSRGASIYRGVTRHHQQGRWQARIGRVAGNKDLYLGTFATEEEAAEAYDIAAIKFRGINAVTNFEMNRYDIEAVMNSSLPVGGAAAKRHKLKLALESPSSSSSDHNLQQQQLLPSSSPSDQNPNSIPCGIPFEPSVLYYHQNFFQHYPLVSDSTIQAPMNQAEFFLWPNQSY

SEQ ID NO: 385 - DNA, 765 bp, Arabidopsis thaliana
  G1839,family:AP2
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 386 - protein, 184 aa, Arabidopsis thaliana
  G1839,AP2 domain coordinates 118-182
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 387 - DNA, 1059 bp, Arabidopsis thaliana
  G1842,family:MADS
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 388 - protein, 196 aa, Arabidopsis thaliana
  G1842,MADS domain coordinates 2-57
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 389 - DNA, 818 bp, Arabidopsis thaliana
  G1843,family:MADS
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 390 - protein, 200 aa, Arabidopsis thaliana
  G1843,MADS domain coordinates 2-57
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 391 - DNA, 834 bp, Arabidopsis thaliana
  G1844,family:MADS
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 392 - protein, 198 aa, Arabidopsis thaliana
  G1844,MADS domain coordinates 2-57
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 393 - DNA, 942 bp, Arabidopsis thaliana
  G1847,family:WRKY
atggaaatgatgaattgggagcggaggagtttgctaaacgagctaattcatggactaaaagcggccaagcagcttcagggttcgtcttctccatcgttgtcagcttcttcttcatatttgacgacggagataaaggagaatctcttacataacatagtttcttccttcaaaaaagctattttgatgctcaacggatccaccacacaacacaatccaacgatagagcttgcgcctgatcccctagctcatcccggaaaggttccaggatctccagcatcgatcaccggaaatccgagaagcgaagagtttttcaatgtaagatcgaaagaattcaacttaagttctaaaaagaggaagatgttgccaaagtggacagagcaagtgagaattagcccagagagaggcttagaaggacctcatgacgatatcttcagctggagaaaatatggccagaaagacattttgggcgccaaattcccaaggagttattacagatgcacatttcgtaacacacagtactgttgggctacgaaacaagtccaaagatcggacggtgatccaacgatcttcgaagtaacatacagaggaacacacacttgttcacaggggatcccacttccagagaaacgagaaaccaaaccaaaacacacagtagcagtaaattaccagaatctcagggccagtcttaccgtacgtaccggcggacttggaagcgaagctttctcattccccgtcacgtcgccgttatacacttacgagtccatcaacggtggtggaacgttttaccaccacgtgggaagttctggtccgtcggatttcactggattgatctcaacaaatacttccacaggaagttctccaatcttcgacgttaattttcaatttgatccaacggctgagattaacacaggcttccccacttttttccacaattcgatttaa

SEQ ID NO: 394 - protein, 313 aa, Arabidopsis thaliana
  G1847,WRKY domain coordinates 141-200
MEMMNWERRSLLNELIHGLKAAKQLQGSSSPSLSASSSYLTTEIKENLLHNIVSSFKKAILMLNGSTTQHNPTIELAPDPLAHPGKVPGSPASITGNPRSEEFFNVRSKEFNLSSKKRKMLPKWTEQVRISPERGLEGPHDDIFSWRKYGQKDILGAKFPRSYYRCTFRNTQYCWATKQVQRSDGDPTIFEVTYRGTHTCSQGIPLPEKRETKPKHTVAVNYQNLRASLTVRTGGLGSEAFSFPVTSPLYTYESINGGGTFYHHVGSSGPSDFTGLISTNTSTGSSPIFDVNFQFDPTAEINTGFPTFFHNSI

SEQ ID NO: 395 - DNA, 1134 bp, Arabidopsis thaliana
  G1850,family:HS
atgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatga

SEQ ID NO: 396 - protein, 377 aa, Arabidopsis thaliana
  G1850,HS domain coordinates 59-150
MPGEQTGETPTVAGVGGGGAGCSAGNSGGSSGCGAGGGGGGSGGGGGGGGDSQRSIPTPFLTKTYQLVEDPVYDELISWNEDGTTFIVWRPAEFARDLLPKYFKHNNFSSFVRQLNTYGFRKVVPDRWEFSNDCFKRGEKILLRDIQRRKISQPAMAAAAAAAAAAVAASAVTVAAVPVVAHIVSPSNSGEEQVISSNSSPAAAAAAIGGVVGGGSLQRTTSCTTAPELVEENERLRKDNERLRKEMTKLKGLYANIYTLMANFTPGQEDCAHLLPEGKPLDLLPERQEMSEAIMASEIETGIGLKLGEDLTPRLFGVSIGVKRARREEELGAAEEEDDDRREAAAQEGEQSSDVKAEPMEENNSGNHNGSWLELGK

SEQ ID NO: 397 - DNA, 1902 bp, Arabidopsis thaliana
  G1855,family:AKR
atggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatgatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactag

SEQ ID NO: 398 - protein, 633 aa, Arabidopsis thaliana
  G1855,AKR domain coordinates 102-613
MAKENSGHHHQTEARRKKLTLILGVSGLCILFYVLGAWQANTVPSSISKLGCETQSNPSSSSSSSSSSESAELDFKSHNQIELKETNQTIKYFEPCELSLSEYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVKTYWTGQPSDKNNNNNNNNNN

SEQ ID NO: 399 - DNA, 1316 bp, Arabidopsis thaliana
  G1863,family:GRF-like
ccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 400 - protein, 398 aa, Arabidopsis thaliana
  G1863,GRF-like domain coordinates 76-187
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 401 - DNA, 952 bp, Arabidopsis thaliana
  G1865,family:GRF-like
aagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaatt

SEQ ID NO: 402 - protein, 283 aa, Arabidopsis thaliana
  G1865,GRF-like domain coordinates 45-162
MDTLSIKTYLLLSYTFNFPIQIPIFNLSFFFISLSLSLFMATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 403 - DNA, 519 bp, Arabidopsis thaliana
  G1881,family:Z-CO-like
atgcgaattttgtgtgatgcttgtgagagcgccgccgctatcgtcttttgcgccgccgacgaagctgccctctgttgctcctgcgacgaaaaagttcataagtgcaacaagctggctagtcggcatcttcgtgtaggcttagctgatccgagtaatgcaccaagctgtgacatatgcgaaaatgcacccgcattcttttactgtgagatagatggtagttccctttgtctacaatgtgatatggtggtacatgttggtgggaagagaacacataggcggtttctattactgagacagagaattgagtttccaggcgataagcctaatcatgctgaccaactgggactacggtgtcaaaaggcttcctctggtcgtggtcaagaatcaaatgggaatggtgatcatgatcataatatgatcgatcttaactccaatcctcaaagagtacacgagcctggatcacataaccaagaggagggtattgatgtaaataacgcaaacaatcacgagcatgaatag

SEQ ID NO: 404 - protein, 172 aa, Arabidopsis thaliana
  G1881,Z-CO-like domain coordinates 5-28,56-79
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 405 - DNA, 741 bp, Arabidopsis thaliana
  G1884,family:Z-Dof
atgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaa

SEQ ID NO: 406 - protein, 246 aa, Arabidopsis thaliana
  G1884,Z-Dof domain coordinates 43-71
MMTSSHQSNTTGFKPRRIKTTAKPPRQINNKEPSPATQPVLKCPRCDSVNTKFCYYNNYSLSQPRHYCKNCRRYWTRGGALRNVPIGGSTRNKNKPCSLQVISSPPLFSNGTSSASRELVRNHPSTAMMMMSSGGFSGYMFPLDPNFNLASSSIESLSSFNQDLHQKLQQQRLVTSMFLQDSLPVNEKTVMFQNVELIPPSTVTTDWVFDRFATGGGATSGNHEDNDDGEGNLGNWFHNANNNALL

SEQ ID NO: 407 - DNA, 729 bp, Arabidopsis thaliana
  G1888,family:Z-CO-like
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 408 - protein, 242 aa, Arabidopsis thaliana
  G1888,Z-CO-like domain coordinates 2-33,58-100
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 409 - DNA, 1115 bp, Arabidopsis thaliana
  G189,family:WRKY
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 410 - protein, 317 aa, Arabidopsis thaliana
  G189,WRKY domain coordinates 240-297
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 411 - DNA, 951 bp, Arabidopsis thaliana
  G1896,family:Z-Dof
atgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttga

SEQ ID NO: 412 - protein, 316 aa, Arabidopsis thaliana
  G1896,Z-Dof domain coordinates 43-85
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 413 - DNA, 630 bp, Arabidopsis thaliana
  G1898,family:Z-Dof
atgccgtcggaaccaaaccaaacccgacccaccagagttcagccctcaacggcggcttacccaccgccaaatctggctgagcctcttccttgtcctcgctgcaactccaccaccaccaagttctgttactacaacaactataacctcgctcagcctcgctactactgcaaatcttgccgccgttactggactcaaggtggtacactccgtgacgtccccgtcggtggtggaactcgtcgaagctcctcaaaacgtcaccgttctttctccaccactgccacctcctcttcctcctcttcttccgtcatcaccaccacgacacaagaaccagccacgactgaagcgagtcaaactaaggttactaatttaatttcaggtcatggaagctttgcttctctgttaggtttaggaagtggaaatggtgggttggattacgggtttgggtacgggtacgggcttgaggagatgagtattgggtatcttggagattcttccgtaggagagattccggtggttgatggttgtggtggtgacacgtggcagattggggagattgaaggtaaaagtggaggagacagtttgatatggcctggtcttgagatctcaatgcaaaccaacgatgttaagtga

SEQ ID NO: 414 - protein, 209 aa, Arabidopsis thaliana
  G1898,Z-Dof domain coordinates 31-59
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 415 - DNA, 1055 bp, Arabidopsis thaliana
  G19,family:AP2
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 416 - protein, 248 aa, Arabidopsis thaliana
  G19,AP2 domain coordinates 76-143
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 417 - DNA, 1034 bp, Arabidopsis thaliana
  G190,family:WRKY
gaaaaagaaaacaaacaagaaacacatacacacacacacaagttcactatactctatggaaatgaactccccacacgaaaaggcggtgcaagctatccgttatggccatagctgcgccatgcggttgaagaggcggctcaaccatccaatggctgatggtggaccgctttcaagttatgatcttgctaaatcgatcgttgaaagtttttccaatgccatttcaatcttatctgctaaaccagaaaccgaagatgatcagttttctgatttatcttctagggattcttctcctcctccacaggggagcccctccaagaaaagaaagattgatagtacaaattcaagtgagaattggagggacgattcaccggatccgatttactacgacgggtatctttggaggaaatatggtcaaaagagtataaaaaaatctaatcaccaaaggagttactatagatgttcttacaacaaagatcataactgcgaagcaagaaagcatgaacaaaagatcaaagacaatcctccggtttaccgaaccacttactttggccaccacacttgcaaaaccgaacataatctagatgccatttttattgccggacaagatcccctagatgactttaaaagtacccaaatgatccgattcggaaaagatcaggatcaggagaaggaaagccgctcgaacggtttctccttatcggttaagcatgaagaagatatcatcaaagagcaagctatagatcagtaccgtgagataaccagtaatgaccaagattgtcaagatgttatagaagaatatctatcatcaccatcaggctcttatcctccttcatcgtcatctggcagtgaaagtgctgactttaattctgatttgttatttgacaacccagactcgtgggatcgttatgatcagttttacttttgattgcactagatttttcagctaaaactatttaataatgttttcctttttatgagattgtatatatttgagaattgtgactatttaagtatttatgttattgattagataa

SEQ ID NO: 418 - protein, 289 aa, Arabidopsis thaliana
  G190,WRKY domain coordinates 110-169
MEMNSPHEKAVQAIRYGHSCAMRLKRRLNHPMADGGPLSSYDLAKSIVESFSNAISILSAKPETEDDQFSDLSSRDSSPPPQGSPSKKRKIDSTNSSENWRDDSPDPIYYDGYLWRKYGQKSIKKSNHQRSYYRCSYNKDHNCEARKHEQKIKDNPPVYRTTYFGHHTCKTEHNLDAIFIAGQDPLDDFKSTQMIRFGKDQDQEKESRSNGFSLSVKHEEDIIKEQAIDQYREITSNDQDCQDVIEEYLSSPSGSYPPSSSSGSESADFNSDLLFDNPDSWDRYDQFYF

SEQ ID NO: 419 - DNA, 585 bp, Arabidopsis thaliana
  G1901,family:Z-Dof
atgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattga

SEQ ID NO: 420 - protein, 194 aa, Arabidopsis thaliana
  G1901,Z-Dof domain coordinates NA
MQDLTSAAAYYHQSMMMTTAKQNQPELPEQEQLKCPRCDSPNTKFCYYNNYNLSQPRHFCKNCRRYWTKGGALRNIPVGGGTRKSNKRSGSSPSSNLKNQTVAEKPDHHGSGSEEKEERVSGQEMNPTRMLYGLPVGDPNGASFSSLLASNMQMGGLVYESGSRWLPGMDLGLGSVRRSDDTWTDLAMNRMEKN

SEQ ID NO: 421 - DNA, 1200 bp, Arabidopsis thaliana
  G1903,family:Z-Dof
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 422 - protein, 399 aa, Arabidopsis thaliana
  G1903,Z-Dof domain coordinates 134-180
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 423 - DNA, 795 bp, Arabidopsis thaliana
  G1906,family:Z-Dof
atggtggaacgtgctcggatcgcaaaagtcccattgcctgaagcagctctaaattgccctagatgtgactcaaccaatactaagttctgttacttcaataactatagccttactcaacctcgccatttctgcaaaacatgtcgtcgctattggacacgtggcggttccttgaggaatgttcctgttggaggaggctttaggaggaacaagagaagcaaatccagatcgaaatctacggtcgtggtctcgactgataatactactagtacttcatcacttacttctcgcccaagttactcaaaccctagcaagtttcatagctacggtcaaatcccggagtttaattccaacttgcccatcttgcctcctctccaaagccttggagattacaattcaagcaacactggattagattttggtggaactcaaataagcaacatgataagtggtatgagttctagtggtgggatcttggatgcatggagaatacctccatcacaacaagctcagcaattccctttcttgatcaacactaccggattggtgcaatcttcaaacgcgttatatccattactagaaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaa

SEQ ID NO: 424 - protein, 264 aa, Arabidopsis thaliana
  G1906,Z-Dof domain coordinates 19-47
MVERARIAKVPLPEAALNCPRCDSTNTKFCYFNNYSLTQPRHFCKTCRRYWTRGGSLRNVPVGGGFRRNKRSKSRSKSTVVVSTDNTTSTSSLTSRPSYSNPSKFHSYGQIPEFNSNLPILPPLQSLGDYNSSNTGLDFGGTQISNMISGMSSSGGILDAWRIPPSQQAQQFPFLINTTGLVQSSNALYPLLEGGVSATQTRNVKAEENDQDRGRDGDGVNNLSRNFLGNININSGRNEEYTSWGGNSSWTGFTSNNSTGHLSF

SEQ ID NO: 425 - DNA, 885 bp, Arabidopsis thaliana
  G1917,family:GATA/Zn
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 426 - protein, 294 aa, Arabidopsis thaliana
  G1917,GATA/Zn domain coordinates 153-179
MQTPYTTSTQGQYCHSCGMFHHHSQSCCYNNNNNSNAGSYSMVFSMQNGGVFEQNGEDYHHSSSLVDCTLSLGTPSTRLCEEDEKRRRSTSSGASSCISNFWDLIHTKNNNSKTAPYNNVPSFSANKPSRGCSGGGGGGGGGGGGDSLLARRCANCDTTSTPLWRNGPRGPKSLCNACGIRFKKEERRTTAATGNTVVGAAPVQTDQYGHHNSGYNNYHAATNNNNNNGTPWAHHHSTQRVPCNYPANEIRFMDDYGSGVANNVESDGAHGGVPFLSWRLNVADRASLVHDFTR

SEQ ID NO: 427 - DNA, 1483 bp, Arabidopsis thaliana
  G1918,family:RING/C3HC4
tcggagtcaatcttgattccgatgggactcgaatcgggttttggagcgtttgggtgaagacatggagaaactaatgactgaatcaggtttgaaaccagttgttattgattcgaatcaagatttatctcgtgtatattgtgggatctgctctaatattggtgatgacgattatgatggtgatgctgttgttgttgatggtgatttgatctccacgcctttttgttctcacaagttctgcaaagcttgttggagcaagtatcttaagaaaaatttcttctctgtggagaaaaaccacactgcaatctcttgtcctgatcgagattgtcgagctgctgttggaccggagacggttgagaagctaaccgtacgtgatcaagcgatgtacgagttgtatattctgaaatcttaccgtgagaaatacctgggatggaagctcaaactgtgtcctgcacggggttgcaattacgtgattgagtttcatctggcaagtgaagatgaagagcatagcttaaacattgtgtgtctctgtggtcatatcttctgttggagatgcatgcttgagtcacacagaccagtgacctgcaacaacgcttctgattggttgtctagagacttggagaaattgatagaagaagtagacaagccatcgaccgtctcctggattgatgccaataccaagccttgccctcattgctttattcctgtggagattgatggtgaacgaccatgggcccagttcttgacttgtgtctgcagcggtcgtttctgttggaagtgttttcggtcaccggaaactcacggaacctcaggatcctgtttggcaccggcgcgttcgagcaatgttggtttcaatcattggaacagagcaaaaccggggatttcgtgtttggatctctggaatgcgagtcaagtgaatctggtgaacgctaaatacgagctagaagctttcgaggaatccataatcaagaaacctagtgacttgaaggagcaagacgttaaggtactaagggaaggactgatgctcattgttcagtgcagacagttcctcaaatggagctgtgcgtacgactatatccacacagagtatgatatggcgaagagagagtacctgcgattcctccaacaaaacgcgtctggcattgtccatagtttctcacagagtataaaggaggaaacagaagccaaagagcttacttgcggtaagctattgagcgagacaaccaacattgggaacttcttttatcatttcatcaagactttacgagaaggtttgcccgaggtacaggcggagtcgtacgacaactatggtggtccttactggttgtgcgatcgctgcacatatggaaactcttggttccagagggcctgtaagatgtgctgtgatcctactgcgtctaagatggacgagctaagtgattgatcgcttaactaggtttcttaaagataaaacaaaaggttctaggagacagagtaaccttgcaac

SEQ ID NO: 428 - protein, 452 aa, Arabidopsis thaliana
  G1918,RING/C3HC4 domain coordinates 26-164
MEKLMTESGLKPVVIDSNQDLSRVYCGICSNIGDDDYDGDAVVVDGDLISTPFCSHKFCKACWSKYLKKNFFSVEKNHTAISCPDRDCRAAVGPETVEKLTVRDQAMYELYILKSYREKYLGWKLKLCPARGCNYVIEFHLASEDEEHSLNIVCLCGHIFCWRCMLESHRPVTCNNASDWLSRDLEKLIEEVDKPSTVSWIDANTKPCPHCFIPVEIDGERPWAQFLTCVCSGRFCWKCFRSPETHGTSGSCLAPARSSNVGFNHWNRAKPGISCLDLWNASQVNLVNAKYELEAFEESIIKKPSDLKEQDVKVLREGLMLIVQCRQFLKWSCAYDYIHTEYDMAKREYLRFLQQNASGIVHSFSQSIKEETEAKELTCGKLLSETTNIGNFFYHFIKTLREGLPEVQAESYDNYGGPYWLCDRCTYGNSWFQRACKMCCDPTASKMDELSD

SEQ ID NO: 429 - DNA, 1029 bp, Arabidopsis thaliana
  G1923,family:NAC
atggagaagatgatagaaccacgggacaacacaagagaatcagaagatgaggatgcgttaaagcttccagggtttaggtttcatccgacggatgaggagcttgtagggtattatctctctaaaaaagtgcttctcaaaaaaacgagcaagattgatgagatcgtcagccaaattgatatctataaatttgatccgtgggatcttccaaggtcgaggaatacagagaaggagagctacttcttttgtaagagaggaaggaaatacagaaacagcataagaccgaaccgagtgactggttccggtttctggaaagccacagggatagacaagcctgtctattccgatggatccaacaaagccgtgatcggtctaaagaagacactcgtttattacctaggaagcgccgggaaaggaaacaagacggattggatgatgcacgagtttcgtctccctacagccaatgacacaatccccggtggccctacacactctaaccctactccaacttccttgctacacgcggaagtatggacgttatgccggatatttaagagaactgtgtctagtcgaaaatacactccggactggagagaattagcaaatggcaaacgtgtgaagcagcaacaatctaattaccaagaagcttatataaattttggggacaatgaaagtagtagtagtaccaacgtgatgaacgttagggaaggcaaagggaactacgagagaagcgttttccagcttcagcaaacgccttatcaacatcaaaaccagccaattctcatggacaccacacacgttgattcgtttcaacatttctccaacgataacattcaccatgaaacctacgagacttggccggacgagcttcgatcggttgtggaatttgctttcccaccttcttttcttagttagatctctagaataattaacaactaatatgtatacatattacatattactagcttggacgtgttgtatcatcagatctctactgtatacatggatcgtgtgtatatgaatatgcacctg

SEQ ID NO: 430 - protein, 303 aa, Arabidopsis thaliana
  G1923,NAC domain coordinates 23-153
MEKMIEPRDNTRESEDEDALKLPGFRFHPTDEELVGYYLSKKVLLKKTSKIDEIVSQIDIYKFDPWDLPRSRNTEKESYFFCKRGRKYRNSIRPNRVTGSGFWKATGIDKPVYSDGSNKAVIGLKKTLVYYLGSAGKGNKTDWMMHEFRLPTANDTIPGGPTHSNPTPTSLLHAEVWTLCRIFKRTVSSRKYTPDWRELANGKRVKQQQSNYQEAYINFGDNESSSSTNVMNVREGKGNYERSVFQLQQTPYQHQNQPILMDTTHVDSFQHFSNDNIHHETYETWPDELRSVVEFAFPPSFLS

SEQ ID NO: 431 - DNA, 945 bp, Arabidopsis thaliana
  G1925,family:NAC
atggaagaaaatcttcctccggggttcagatttcatcctacagacgaggagctcataacgcattatctatgtcggaaagtctccgatataggattcaccggtaaagctgtcgtcgacgttgatctcaacaagtgtgaaccttgggatttgccagccaaggcttcaatgggagagaaagagtggtatttcttcagccaaagggatcggaaatatccaaccggtttaagaacaaaccgggcaacagaagctggttactggaaaaccaccgggaaagataaagaaatataccgaagtggagtgttggttgggatgaagaaaaccctagttttctacaaaggaagagctcccaaaggtgagaaaagcaattgggttatgcatgagtacaggcttgagagcaaacaacctttcaaccccacgaataaggaggaatgggtagtgtgtagggttttcgaaaagagcacggcagcaaagaaagcacaagaacaacaacctcaatcttctcaaccatcttttggatctccatgcgatgcaaactcatcaatggcaaatgagtttgaagatattgatgagcttccgaatctgaattcaaactcatcaaccatcgattacaataatcatatccatcaatattcgcaacgcaatgtttactcagaagacaacacaacaagtacggctggtctcaacatgaacatgaacatggctagtactaatcttcagtcttggacaacaagtctccttggtccgcctttatctccaatcaactctttgttgctcaaggctttccaaatcaggaactcttatagtttcccaaaagagatgatccccagtttcaatcattcttctcttcaacaaggagtctccaatatgatccaaaatgcttcaagttcgtctcaagtgcaaccccaaccgcaagaggaagcgtttaatatggactccatatggtga

SEQ ID NO: 432 - protein, 314 aa, Arabidopsis thaliana
  G1925,NAC domain coordinates 6-150
MEENLPPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVFEKSTAAKKAQEQQPQSSQPSFGSPCDANSSMANEFEDIDELPNLNSNSSTIDYNNHIHQYSQRNVYSEDNTTSTAGLNMNMNMASTNLQSWTTSLLGPPLSPINSLLLKAFQIRNSYSFPKEMIPSFNHSSLQQGVSNMIQNASSSSQVQPQPQEEAFNMDSIW

SEQ ID NO: 433 - DNA, 1451 bp, Arabidopsis thaliana
  G1933,family:WRKY
aattgagattaaagtaatttatctttcagaaaatggcggttgaagacgatgtatctttgataagaacgacgacgttagtggcaccaacaagacccacgattacagttcctcatagacctccggcgatcgaaacggcggcgtatttctttggcggtggagatgggcttagtctaagcccagggccactttcttttgtctcttctttgtttgttgataacttccctgacgtcttgacgccggataaccaacggacgacgtcgtttactcagcttcttaacggaactatgtcggtgtctcctggtggcggaggacgttcaacggcggggatgttcgccggaggaggtccgatgtttacaatcccttctggtttcagcccttctagtcttctcacctcgcccatgttctttcccccgcagtcgtcagctcataccggctttattcaaccacggcagcagtcacaaccgcaaccacaacgaccagacacgtttcctcaccatatgccaccatcgacatccgtcgccgtccatggtcgtcaatctttagacgtttcacaagtagatcaaagagctcgaaaccattataataatccggggaataacaataataaccggtcgtataacgttgtgaacgttgataaaccggcggatgacggttataactggaggaagtacggacaaaagcctatcaaagggtgtgaatatccaaggagttattacaaatgtacacatgttaactgtccggtgaagaagaaagtcgaacggtcatcggatggacagatcactcagatcatttacaaaggtcaacatgatcacgagaggcctcagaatcgccgtggcggtggaggcagagattccactgaggttggtggtgcagggcaaatgatggaatctagtgatgatagtggttatcgtaaggatcatgatgatgatgatgatgatgatgaagatgatgaagatcttccggcttcaaagataagaagaatagacggtgtgtcgacgactcaccggacggtgaccgagcctaagattatcgttcagacaaaaagtgaagtcgatcttctcgacgatggctataggtggcgtaagtacggacaaaaagttgtcaaaggaaatccccatccaaggagctattataaatgtacaacgccaaattgtacggtccgtaaacatgtagagagagcttccacggatgctaaggctgtgattacaacttacgaaggtaaacacaatcacgatgtccctgccgctagaaacggtaccgcggcagcaaccgcagctgcggtggggccgtctgaccaccatcgtatgagatcaatgtcggggaacaatatgcaacaacatatgagtttcggtaacaataataacacaggccaatctccggttcttttgaggttgaaagaagagaaaatcacaatttgacttttaagaaccaaagatttcgagattgatatt

SEQ ID NO: 434 - protein, 461 aa, Arabidopsis thaliana
  G1933,WRKY domain coordinates 205-263,344-404
MAVEDDVSLIRTTTLVAPTRPTITVPHRPPAIETAAYFFGGGDGLSLSPGPLSFVSSLFVDNFPDVLTPDNQRTTSFTQLLNGTMSVSPGGGGRSTAGMFAGGGPMFTIPSGFSPSSLLTSPMFFPPQSSAHTGFIQPRQQSQPQPQRPDTFPHHMPPSTSVAVHGRQSLDVSQVDQRARNHYNNPGNNNNNRSYNVVNVDKPADDGYNWRKYGQKPIKGCEYPRSYYKCTHVNCPVKKKVERSSDGQITQIIYKGQHDHERPQNRRGGGGRDSTEVGGAGQMMESSDDSGYRKDHDDDDDDDEDDEDLPASKIRRIDGVSTTHRTVTEPKIIVQTKSEVDLLDDGYRWRKYGQKVVKGNPHPRSYYKCTTPNCTVRKHVERASTDAKAVITTYEGKHNHDVPAARNGTAAATAAAVGPSDHHRMRSMSGNNMQQHMSFGNNNNTGQSPVLLRLKEEKITI

SEQ ID NO: 435 - DNA, 955 bp, Arabidopsis thaliana
  G1936,family:PCF
tcgacccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatac

SEQ ID NO: 436 - protein, 243 aa, Arabidopsis thaliana
  G1936,PCF domain coordinates 64-129
MVMEPKKNQNLPSFLNPSRQNQDNDKKRKQTEVKGFDIVVGEKRKKKENEEEDQEIQILYEKEKKKPNKDRHLKVEGRGRRVRLPPLCAARIYQLTKELGHKSDGETLEWLLQHAEPSILSATVNGIKPTESVVSQPPLTADLMICHSVEEASRTQMEANGLWRNETGQTIGGFDLNYGIGFDFNGVPEIGFGDNQTPGLELRLSQVGVLNPQVFQQMGKEQFRVLHHHSHEDQQQSAEENGS

SEQ ID NO: 437 - DNA, 1418 bp, Arabidopsis thaliana
  G194,family:WRKY
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 438 - protein, 337 aa, Arabidopsis thaliana
  G194,WRKY domain coordinates 174-230
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 439 - DNA, 1445 bp, Arabidopsis thaliana
  G1944,family:AT-hook
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 440 - protein, 356 aa, Arabidopsis thaliana
  G1944,AT-hook domain coordinates 89-97,170-285
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 441 - DNA, 1076 bp, Arabidopsis thaliana
  G1947,family:HS
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 442 - protein, 282 aa, Arabidopsis thaliana
  G1947,HS domain coordinates 19-110
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 443 - DNA, 883 bp, Arabidopsis thaliana
  G1950,family:AKR
ctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgt

SEQ ID NO: 444 - protein, 240 aa, Arabidopsis thaliana
  G1950,AKR domain coordinates 65-228
MEIATDTAKQMRDEELFKAAEWGDSSLFMSLSEEQLSKSLNFRNEDGRSLLHVAASFGHSQIVKLLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRPALIDAAKAMLEG

SEQ ID NO: 445 - DNA, 1216 bp, Arabidopsis thaliana
  G1957,family:ABI3/VP-1
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaagtttcatcatcttcttgttttgaatctctctttatattgtttccattagtaatttttactaagggtattagattctagctagt

SEQ ID NO: 446 - protein, 358 aa, Arabidopsis thaliana
  G1957,ABI3/VP-1 domain coordinates 52-143
MDLSLAPTTTTSSDQEQDRDQELTSNIGASSSSGPSGNNNNLPMMMIPPPEKEHMFDKVVTPSDVGKLNRLVIPKQHAERYFPLDSSNNQNGTLLNFQDRNGKMWRFRYSYWNSSQSYVMTKGWSRFVKEKKLDAGDIVSFQRGIGDESERSKLYIDWRHRPDMSLVQAHQFGNFGFNFNFPTTSQYSNRFHPLPEYNSVPIHRGLNIGNHQRSYYNTQRQEFVGYGYGNLAGRCYYTGSPLDHRNIVGSEPLVIDSVPVVPGRLTPVMLPPLPPPPSTAGKRLRLFGVNMECGNDYNQQEESWLVPRGEIGASSSSSSALRLNLSTDHDDDNDDGDDGDDDQFAKKGKSSLSLNFNP

SEQ ID NO: 447 - DNA, 1116 bp, Arabidopsis thaliana
  G1959,family:GARP
cgtcgactgtccataaatccggagcctgacccgacgtttgacccggatccgaaactcccacaatctccataccacccaaattcatctcccctaaagctttctctcactttcccgggaaaatcggcgaccaaaattggaaaatgtactcagcgattcgctcgcttccactcgatggtggacacgttggtggtgactaccatggacctcttgacggaaccaatcttcccggtgacgcttgtttggttttaacgactgaccctaaacctcgtctccggtggacaactgagcttcatgagagattcgttgacgccgttactcagctcggtggtcctgacaaagcgactcccaaaactattatgagaacaatgggagtgaagggtctcactctctaccacctcaaatcacatcttcagaaattccgcctagggaggcaagctggcaaagaatcaactgagaactctaaagatgcttcttgtgtaggggagagtcaggacacaggttcatcttcgacatcatcaatgagaatggcgcagcaggagcagaacgagggttaccaagtcaccgaagctctacgtgctcagatggaagtccaaagaagactacacgatcaattggaggtgcaacggaggctccagctgaggatagaggcacaaggaaaatacctgcaatcgattcttgaaaaagcttgcaaggcctttgacgagcaagctgctacttttgctggacttgaggctgctagggaagagctatcagagctagccatcaaagtctccaatagctctcaaggaacatcagtcccgtacttcgatgcaacaaagatgatgatgatgccatcgttgtcagagcttgcagtagcaatagacaacaaaaacaacatcacaaccaactgttcagtagaaagctctctgacttccatcacacatgggagctctatatctgctgcatcaatgaagaagcgtcaacgtggagacaatttgggcgtagggtatgaatcaggctggattatgcctagtagcaccattggataaagtttaggagagggaaaaagttcattatgggaaaggtagagataagatttaactgttctttacttgctttgaggggcctgcggccgct

SEQ ID NO: 448 - protein, 295 aa, Arabidopsis thaliana
  G1959,GARP domain coordinates 46-97
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 449 - DNA, 609 bp, Arabidopsis thaliana
  G1965,family:Z-Dof
atggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttga

SEQ ID NO: 450 - protein, 202 aa, Arabidopsis thaliana
  G1965,Z-Dof domain coordinates 27-55
MDNFNVVANEDNQVNDVKPPPPPPRVCARCDSDNTKFCYYNNYSEFQPRYFCKNCRRYWTHGGALRNVPIGGSSRAKRTRINQPSVAQMVSVGIQPGNRFSSLSHIHGGMVTNVHPTQTFRPNHRLAFHNGSFEQDYYDVGSDNLLVNQQVGGYVDNHNGYHMNQVDQYNWNQSFNNAMNMNYNNASTSGRMHPSHLEKGGP

SEQ ID NO: 451 - DNA, 1155 bp, Arabidopsis thaliana
  G1969,family:Z-C2H2
atgctgaaacaggttcaatcagatgaaagttttcatcttggtggcaaaatccataaccttcatgtatgtggttaccagaggattgattctggtgtttactcgaaaaagtatggctttgaattgtctcctcatgatgatgattccatggatttagatggtgttgagttgttactagacttgagggaaatggtttctcaatcgggtttcgaaaagtctactacttgcagtggtgttattgctctgagaagtaatctgcagagtaaatcaagtcacaaatgcaaaatatgtggcaagagttttgagtgttatcaagctctaggtggtcaccaaagaattcacagaccgattaaagagaaactaaaaagacctgagagtagtagctcctgctatgaatgcaaagtatgtggcaagatttttgggtgttatcgaggtctaggtggccacacgaaacttcacagatcgactaagagggaattagcgagtactcaagatgagaattcactgttagactcatcagaagctaagaagattgtttcacaaccatcaagctttaaagtctctcaggaggagaagttcttacattgtgtggagttaaaacaagacttcagtgaaccgctttctcattcgggtgcattaccatctactctgagaagtaaattgcagacaaaaactcagtggaaatcaagctgtcattgcaaaatatgtggcaagagttttgtgtgttctcaaggtttaggtaatcacaaaagagttcacagagagattagcgggaaattagcgtgtaaaaggaagtacactgaagactataatccattctctgactcattaaaagctaagaagattgttaaaaaaccatcaagctttgaagtctctcaggaggagaagatcttacattgtgttgagttaaaacaagacttcggtgaactgcttgctcactcgggtttcgacaagtctattagttgcagcaaatcgatcaaagtgaaaaaagtagcgcgtaaaaatgagaaaactgaagatagtacttcactgtttggcgtgattgactcagaagctagcaagtttgcttcactaccatcaagcattgaaatctatcatgagaagaccttccattgtgttgagtcaaaacaagacttcagtgaactgttttctcgctag

SEQ ID NO: 452 - protein, 384 aa, Arabidopsis thaliana
  G1969,Z-C2H2 domain coordinates 93-113,129-152,230-252
MLKQVQSDESFHLGGKIHNLHVCGYQRIDSGVYSKKYGFELSPHDDDSMDLDGVELLLDLREMVSQSGFEKSTTCSGVIALRSNLQSKSSHKCKICGKSFECYQALGGHQRIHRPIKEKLKRPESSSSCYECKVCGKIFGCYRGLGGHTKLHRSTKRELASTQDENSLLDSSEAKKIVSQPSSFKVSQEEKFLHCVELKQDFSEPLSHSGALPSTLRSKLQTKTQWKSSCHCKICGKSFVCSQGLGNHKRVHREISGKLACKRKYTEDYNPFSDSLKAKKIVKKPSSFEVSQEEKILHCVELKQDFGELLAHSGFDKSISCSKSIKVKKVARKNEKTEDSTSLFGVIDSEASKFASLPSSIEIYHEKTFHCVESKQDFSELFSR

SEQ ID NO: 453 - DNA, 1540 bp, Arabidopsis thaliana
  G1972,family:Z-C2H2
ggtttttgtgtggattctagcttcaaagtcgatggaccaattacgaggttacaaaaccaactgtggattctcacttgggaaaccgagattcggatctattaaggttaaaatcccaaggatcaaacctgagatagaagaagaccaagtagaagaagatgatgaagctaaaaacatcggtctcgaggaagaggaaaatgatcatgaagctaagagtatggatctagagcaaggagatgtggaagaagaagaaggagaagagaaaaaacatatatgttgtgaatgtggtaaaaggtttgtgtcaggtaaagctttaggaggtcataaacggattcatgtgctcgaaactcgtaaattctcaatgatgagaccaaagatggtgtctggtatggttggtagatctgaaagaggtgacttagaagtggcttgttgtgtttgttacaagaagtttacatcaatgaaggctttatatggacacatgaggtttcatccagacagaggttggaaaggtgttttgcctcctcctcctcttcttcctcatccacttggtaattcatcgtcttctacacttgatcatgatgatgagtttataagctcagattatgatgatgatgatgattttgatgatgatgatgatgatgatgatgatgagaactcggagttatgggacagtaatttggaattggaaaacgttgttgaatcgattaaaggatggtcaacaaaagggaagagaggaaggagaggtgatttgaagtttgatgaagcagatttgaaggatccacctttagaagatgtgaaggatattgatgatgctaatggtctattgttcttagctactactgcagaagcagctgctaatcttaatgttgctgagacttctgcttcgcgttccgttgaagagaaatatctggaaatggtcaagaagaggaagaagaagcagaagagattgtctgagatggagaaagagtcatcaacatctactcatcatgatcatcagcttgatcaggttgttgttgttgcagctgaggaaggtggtggtgccggtgcacgtgagaagcacgtgtgtgtgacttgcaacaagtcgtttagttcttatcaagctttaggaggtcatagagcaagtcacaacaaggtcaagatattggagaatcatcaagctagggcaaacgctgaagcttcattacttggaactgaagcaataataaccggtttagctagtgctcaaggaacaaacacatctttaagcagtagtcataatggagatcatgtttgtaatatatgtcacaaaagcttctcaacaggtcaagctcttggtggtcacaagagatgtcattggactgcaccagtttctactgtggctccaaccacggttccaaccgctgctccaaccgttccagcaactgcgtcttctagtcaagtaacagagacagtacaagaggtgaagaaattgaagagaagagttttggagtttgacttgaatgagttgccacctaacgaagaagaagaaagagtctaagagacgtatatatgcaagcaagtaatc

SEQ ID NO: 454 - protein, 493 aa, Arabidopsis thaliana
  G1972,Z-C2H2 domain coordinates 79-101,132-152,342-364,411-433
MDQLRGYKTNCGFSLGKPRFGSIKVKIPRIKPEIEEDQVEEDDEAKNIGLEEEENDHEAKSMDLEQGDVEEEEGEEKKHICCECGKRFVSGKALGGHKRIHVLETRKFSMMRPKMVSGMVGRSERGDLEVACCVCYKKFTSMKALYGHMRFHPDRGWKGVLPPPPLLPHPLGNSSSSTLDHDDEFISSDYDDDDDFDDDDDDDDDENSELWDSNLELENVVESIKGWSTKGKRGRRGDLKFDEADLKDPPLEDVKDIDDANGLLFLATTAEAAANLNVAETSASRSVEEKYLEMVKKRKKKQKRLSEMEKESSTSTHHDHQLDQVVVVAAEEGGGAGAREKHVCVTCNKSFSSYQALGGHRASHNKVKILENHQARANAEASLLGTEAIITGLASAQGTNTSLSSSHNGDHVCNICHKSFSTGQALGGHKRCHWTAPVSTVAPTTVPTAAPTVPATASSSQVTETVQEVKKLKRRVLEFDLNELPPNEEEERV

SEQ ID NO: 455 - DNA, 1146 bp, Arabidopsis thaliana
  G1981,family:Z-C3H
atggacgtcgaacatcacaaatccggccacatcagtagaccaacggtggatattccaccgaggaagcttctttcctccgccaagtctccgtcgtcagtttcaagtccccttcgcgactataaagaacagaaagactattgttacgactctgactctgaggatccttacgctggagaccatttccggatgtacgaattcaagatccgacggtgcacgcgtagccgtagccatgactggaccgactgtcctttctctcatcccggtgaaaaggctcgtcgccgtgaccctcgccggtttcactacaccggagaagtatgccctgagtttagccgtcacggtgattgtagccgtggtgatgaatgcggtttcgctcacggggttttcgagtgttggcttcatccgagtcgttaccgtacggaagcttgtaaagacggtaagcattgtaagaggaaagtttgtttctttgctcattctccacgtcagctgagagttcttccaccgtccccggagaatcatatttccggtggttgcggtggatcaccgtcgtcatcccctgcatcggttttaagcaataaaaataatcgatgttgcttgttttgttcccattctccgacgagtactctcttgaatttatcacgatcaccttcatcgtctccgcctttgtctccagctgataaagccgatgcattttcacggctgagccgccgtcgcaccgccgtactaaacgaactgattagttctttagattccttaagtctcacggaagcacttgcagcttcttcatcgtctcccgttaccatgcccatttccacggcgacgatgatcgcttcatcgaatctaagcagcaaccaccaccaccaccgtcttccgccgtggcttgatgtcggagacagagatctccaattacaacagagtagtcctctacgatttgctctttcaccttcttcaactccaagttacctccatggccagcttcagccaccaccgtcgagcttctttggcgatgaattcacaccacgtggtggccggctaagcgatttctcggtggctgcagctgcggcggcccaagctagggataaaaatagctttgaagtcggttctagtggcgatcttgatctaggatgggtgaacgatcttttgacatga

SEQ ID NO: 456 - protein, 381 aa, Arabidopsis thaliana
  G1981,Z-C3H domain coordinates 45-157
MDVEHHKSGHISRPTVDIPPRKLLSSAKSPSSVSSPLRDYKEQKDYCYDSDSEDPYAGDHFRMYEFKIRRCTRSRSHDWTDCPFSHPGEKARRRDPRRFHYTGEVCPEFSRHGDCSRGDECGFAHGVFECWLHPSRYRTEACKDGKHCKRKVCFFAHSPRQLRVLPPSPENHISGGCGGSPSSSPASVLSNKNNRCCLFCSHSPTSTLLNLSRSPSSSPPLSPADKADAFSRLSRRRTAVLNELISSLDSLSLTEALAASSSSPVTMPISTATMIASSNLSSNHHHHRLPPWLDVGDRDLQLQQSSPLRFALSPSSTPSYLHGQLQPPPSSFFGDEFTPRGGRLSDFSVAAAAAAQARDKNSFEVGSSGDLDLGWVNDLLT

SEQ ID NO: 457 - DNA, 909 bp, Arabidopsis thaliana
  G1987,family:Z-C2H2
atgtataataataaccaatatagcttctccggtgacgaagactccgtcgtcctcagccttggacctcctggccaacaataccctagccataacaaacctaccagtactaaaccttcttctgatcatgagtttaatcacccattaacaaaccctaatggtgttaccgttgctcttcatatcggtcctccgagttccgacaaagaaacccttagcggcgggaacaaccaagagggtttaacggcgaggcagggacagtattggatcccttcactttcgcagatccttgtcggtcccactcagttctcttgttctgtctgtaacaaaactttcaaccgcttcaacaacatgcagatgcatatgtggggtcatggttcgcaataccgaaaaggcccagagtcgctcagagggacgaagtcgtcatcttcgatactaaggctgccatgttactgttgtgctgaaggttgtaagaacaacatagaccatccaagatcaaagcctctcaaagactttagaacgcttcaaacgcattacaagcggaagcacggagcaaaaccttttcgttgccgcaagaaatgtgaaaaaacgtttgcggtgagaggcgattggagaacgcatgagaaaaattgtgggaagttgtggttttgcgtttgcgggtcagattttaagcataagaggtcacttaaggatcacgttagggctttcggtgatggtcatgcggctcacactgtaagtgatcgggttgtaggcattggggacgcagatgaagatgatgaggaggaggaagaagaggaagaagatgatgtagaagaagaagatgctcatgaagaaaatgttcgtggagagaagaactatgggattagatatgatcactttcgtcgttatggtcagatttctgatgacaattactaa

SEQ ID NO: 458 - protein, 302 aa, Arabidopsis thaliana
  G1987,Z-C2H2 domain coordinates 103-123
MYNNNQYSFSGDEDSVVLSLGPPGQQYPSHNKPTSTKPSSDHEFNHPLTNPNGVTVALHIGPPSSDKETLSGGNNQEGLTARQGQYWIPSLSQILVGPTQFSCSVCNKTFNRFNNMQMHMWGHGSQYRKGPESLRGTKSSSSILRLPCYCCAEGCKNNIDHPRSKPLKDFRTLQTHYKRKHGAKPFRCRKKCEKTFAVRGDWRTHEKNCGKLWFCVCGSDFKHKRSLKDHVRAFGDGHAAHTVSDRVVGIGDADEDDEEEEEEEEDDVEEEDAHEENVRGEKNYGIRYDHFRRYGQISDDNY

SEQ ID NO: 459 - DNA, 1301 bp, Arabidopsis thaliana
  G1990,family:Z-C2H2
cagatctggtaccgtcgacccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaa

SEQ ID NO: 460 - protein, 398 aa, Arabidopsis thaliana
  G1990,Z-C2H2 domain coordinates 184-204,261-283
MEAAAEAVSAAREQSLILKGKRTKRQRPQSPIPFSIIPPMSSHEPDAEEESTSLVSKEKSLNDEINNNNIKNNNNTLINGVTSSSSASSSSNNNATLKATADEEDQDMANCLILLAQGHSLPHLQPQPHPQQQTRQLMMSYQDSGNNNNNAYRSSSRRFLETSSSNGTTTNGGGGRAGYYVYQCKTCDRTFPSFQALGGHRASHKKPKAAMGLHSNHDHKKSNYDDAVSLHLNNVLTTTPNNNSNHRSLVVYGKGSNNKVHECGICGAEFTSGQALGGHMRRHRGAVVAAAAASTATVSVAAIPATANTALSLSPMSFDQMSEGPIQAPVKRARSAVVSLDLDLNLPAPEDENRVNGLSFASKQEHEQEHEQTQQKKQREEQKSLVLSSAPTLVDCHY

SEQ ID NO: 461 - DNA, 1260 bp, Arabidopsis thaliana
  G1991,family:Z-C2H2
atgatagactacgagagaagcaataccaccaagaacatcaacacccatcatcacaaccctcctccatcttcatcttcctctgatcttcttcccgacggtaatggaaccgccgtgactcagaagcggaaacggagacccgccgggacaccggatccggaggcggaggtggtatctttatcaccaagaacgttactagaatcggatcggtacgtatgtgagatctgtaaccaagggtttcaaagggaccagaatctacagatgcatagaagacgacataaagttccatggaagcttcttaaaagagagaccaacgaggaagtgaggaaaagagtctacgtctgtccggagccgacatgtctccaccacaacccttgccacgcgctcggagatctcgtgggaatcaagaaacacttccgacggaaacatagtaaccacaagcaatggatctgcgagcgatgctcaaaaggctacgcagttcaatctgattacaaagctcatctcaaaacctgtggcactcgcggccactcctgtgactgcggccgagttttttccagagtggaaagtttcatagagcaccaagacacttgcaccgtacgccgatcccaaccctccaaccaccgtttacatgagcagcaacaacataccacaaacgctacacaaaccgcttcaaccgcggaaaacaacgagaacggggacctctccattggtcctatattgcctggacatcctttacaaagaagacaatccccaccgtcggaacaacaaccatccactttgctctatcccttcgttactaatggtagtatcgagcttcagctacttccatcgaggaattgtgctgatgagaccagccttagtctgtctatagggacaatggatcaaaagacaatgtcggaagttgagaagaagagctacgagaagggagaaacgagcctagaaagagaggaggcgagaagagaaacaaagaggcagatcgaaatcgcggaattggagtttgctgaagccaagagaataaggcaacatgcgagagctgagcttcacaaagctcatctttttagagaagaagcaagtaggaggattagtgcaacgatgatgcaaataacttgccacaattgcaagcaacattttcaagctccggctgctttggttcctcctcctcctcagacgcattgtaccgatgagagcacgtctctggccgtgagctacatgtcttcggcgactaccgaaggagaaaaggcgagtgatagagcatcttcatag

SEQ ID NO: 462 - protein, 419 aa, Arabidopsis thaliana
  G1991,Z-C2H2 domain coordinates 71-92,150-175,369-391
MIDYERSNTTKNINTHHHNPPPSSSSSDLLPDGNGTAVTQKRKRRPAGTPDPEAEVVSLSPRTLLESDRYVCEICNQGFQRDQNLQMHRRRHKVPWKLLKRETNEEVRKRVYVCPEPTCLHHNPCHALGDLVGIKKHFRRKHSNHKQWICERCSKGYAVQSDYKAHLKTCGTRGHSCDCGRVFSRVESFIEHQDTCTVRRSQPSNHRLHEQQQHTTNATQTASTAENNENGDLSIGPILPGHPLQRRQSPPSEQQPSTLLYPFVTNGSIELQLLPSRNCADETSLSLSIGTMDQKTMSEVEKKSYEKGETSLEREEARRETKRQIEIAELEFAEAKRIRQHARAELHKAHLFREEASRRISATMMQITCHNCKQHFQAPAALVPPPPQTHCTDESTSLAVSYMSSATTEGEKASDRASS

SEQ ID NO: 463 - DNA, 1680 bp, Arabidopsis thaliana
  G2,family:AP2
ctctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 464 - protein, 432 aa, Arabidopsis thaliana
  G2,AP2 domain coordinates 129-195,221-288
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 465 - DNA, 1650 bp, Arabidopsis thaliana
  G20,family:AP2
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 466 - protein, 428 aa, Arabidopsis thaliana
  G20,AP2 domain coordinates 68-144
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 467 - DNA, 936 bp, Arabidopsis thaliana
  G2005,family:Z-Dof
atgcaaagcaagaacatgatcgtggcttcatctcatcagcagcaacaacaacagcaaccgcagcagccacaaccgcaacttaaatgccctcgttgcgattcttccaacacaaagttctgctactacaacaactacagcctctctcaaccacggcacttttgcaaggcttgcaagaggtactggacgagaggtgggactctcaggaacgttcccgtagggggtagctaccggaagaacaaacgtgtaaagcggccatcaaccgcaaccacaaccactgcctccaccgtctcgacgactaattcttcatcccctaataaccctcatcagatctctcatttctcttccatgaatcatcatcctttgttctatggtttatcagatcatatgagcagttgtaataataatcttccaatgatcccaagccgtttcagtgattcttcaaagacttgttcatcaagtggtttagagagtgagtttctctcatctggttttagcagtcttagtgctcttggattagggcttccgcatcagatgagtcatgaccacaccattaatggtagcttcatcaacaactccacaacaaacaaaccctttcttctatcgggtctattcggatcctcgatgtcttcttcttctactcttctccagcacccacataaacccatgaacaatggtggtgacatgttgggacaatcccatctccaaaccctagcatcacttcaagatttgcatgttggaggtaacaatgaagatatgaagtacaaagaaggaaagcttgatcagatctctgggaacatcaatgggttcatgtcatcatcatcatctttggatccttcaaactacaacaacatgtggaataatgcaagtgttgtcaatggagcatggcttgatccaacaaataataacgttggatcctccctcacctctttgatataa

SEQ ID NO: 468 - protein, 311 aa, Arabidopsis thaliana
  G2005,Z-Dof domain coordinates 29-71
MQSKNMIVASSHQQQQQQQPQQPQPQLKCPRCDSSNTKFCYYNNYSLSQPRHFCKACKRYWTRGGTLRNVPVGGSYRKNKRVKRPSTATTTTASTVSTTNSSSPNNPHQISHFSSMNHHPLFYGLSDHMSSCNNNLPMIPSRFSDSSKTCSSSGLESEFLSSGFSSLSALGLGLPHQMSHDHTINGSFINNSTTNKPFLLSGLFGSSMSSSSTLLQHPHKPMNNGGDMLGQSHLQTLASLQDLHVGGNNEDMKYKEGKLDQISGNINGFMSSSSSLDPSNYNNMWNNASVVNGAWLDPTNNNVGSSLTSLI

SEQ ID NO: 469 - DNA, 639 bp, Arabidopsis thaliana
  G2006,family:MYB-(R1)R2R3
atgggaagatcaccatgttgtgaaaaggctcacatgaacaaaggagcatggactaaagaagaagatcaacgtcttattgattatatacgtaatcatggtgaaggctcttggcgttctcttcctaaatccgttgggttgttgcgttgtggaaaaagttgtagattaagatggattaattaccttcgtcctgatcttaaacgtggaaatttcactgatggtgaagagcaaatcattgtcaaacttcatagtttatttggcaacaaatggtctttgattgctgggaaattaccgggaagaaccgataatgagattaaaaattattggaacactcatataaaaaggaagcttcttaaccgtggtattgacccaaaaactcacggttcgatcatcgagcctaaaacgacatcgtttcatccccgaaatgaagatttgaagtccacgtttcccggttctgttaaactaaagatggagacttcttgtgaaaactgtgcttctacgagcggtacgactacggacgaggatttacggttaagtgttgattgtgattacagatatgatcatctggacaaggagctaaacttggacctaacactcgggtacagtccgactcgatttgtcggggtcggatcttgttactag

SEQ ID NO: 470 - protein, 212 aa, Arabidopsis thaliana
  G2006,MYB-(R1)R2R3 domain coordinates NA
MGRSPCCEKAHMNKGAWTKEEDQRLIDYIRNHGEGSWRSLPKSVGLLRCGKSCRLRWINYLRPDLKRGNFTDGEEQIIVKLHSLFGNKWSLIAGKLPGRTDNEIKNYWNTHIKRKLLNRGIDPKTHGSIIEPKTTSFHPRNEDLKSTFPGSVKLKMETSCENCASTSGTTTDEDLRLSVDCDYRYDHLDKELNLDLTLGYSPTRFVGVGSCY

SEQ ID NO: 471 - DNA, 861 bp, Arabidopsis thaliana
  G2007,family:MYB-(R1)R2R3
atgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 472 - protein, 286 aa, Arabidopsis thaliana
  G2007,MYB-(R1)R2R3 domain coordinates 14-118
MGRQPCCDKLMVKKGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLKMEIDPSTHQPLNKVFTDTNLVDKSETSSKADNVNDNKIVEIDGTTTNTIDDSIITHQNSSNDDYELLGDIIHNYGDLFNILWTNDEPPLVDDASWSNHNVGIGGTAAVAASDKNNTAAEEDFPERSFEKQNGESWMFLDYCQEFGVEDFGFECYHGFGQSSMKTGHKD

SEQ ID NO: 473 - DNA, 1677 bp, Arabidopsis thaliana
  G2011,family:HS
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 474 - protein, 412 aa, Arabidopsis thaliana
  G2011,HS domain coordinates 55-146
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 475 - DNA, 2076 bp, Arabidopsis thaliana
  G2015,family:AKR
atggacgaactttttgtctcaatctcgtcaacctttagcaaaacctcttgcattactgatcttcttcttccacttgagctagatagaattgaggcacaaaggtcaacagatgcgtctcatgatcaacagaacagaacatacttacccatgaacatacacggttcacaagacttctctcaaagcggaggagatggcgtcacgccacttacaggagacaccgaatctgtgccagagttccttactaaccttagattgtcggatctttacgctatccgtggtgaagatgtccggatgattccagaggtttttagtaaaataagtgatgggaacaaagaatgtctggagaagttgagaagccgtggaatttcagtggcacgtatcaagagcaatacaggagattcaattcttcatcttgctgttacatggggtcatctagaactagtgaaggagattgtctgtgaatgcccgcgtcttctcttggagcaaaactcaagcggtcagacaccgctacatgtggcggctcatagcggtcataccactattgttgaggcttttgtcgcattggtaacattttcttcagctagactgtgtaatgaagagagtgagagaatgaacccatatgttctcaaggacaaagatggaaatactgctctgtactacgcgattgaagggcgctatttcgagatggctgtatgtctggtgaacgcaaaccaggatgctccttttcttggaaataagtatggagtatcttccttgtttgtggcaataaatactggagatgtatctcttgtgaaagcaattttgaaaatcataggcaacaaggaccttaaagggaagaagtctaacttggagtcaaagttacaagggcagaaatctcttgcacatgttgctttggtgacccagagtataggtttgtttttcgctttaaccagtagcagctgcatttattctattcaaatatgtaaaaccagtttgagacgggaatttcctcctcaaggcggtgtccttgatgttattcttgatgaatatccaagtcttatggacgagcgagatataaatggttggacttgtctttcactcgcagcacatatagggtattatgaaggagtatgcaacctcttagaacgatcaacaaaggctgcagagaaaggtcatgaaaatattgttgaagagtttataaaacgatgtccagcaaaaaatgggaaattttggatttcgaacatgttgataattaataaagatacggaacatctgggtgttgggcaagatgtggacgggaatacacctttgcatcttgccgtcatgaactggcactttaaatccattacttggcttgctaggagtagcaagatactgaaagtgcggaacaaaaacggcttaagagctagggatattgccgagagagaggtgaaaccccactacatctttcaggagaggtggacactggcgctcttattatacgctattcactcaaggggtttcgaatctgtacactcattaacaaaaccgtcagtgccactagaccctaaaaataacagagattacgtcaacactcttctcctggtagctgctcttgtagccacaatgacgtttgctgcaggttttacaataccaggtgggtttaacagctctgctccacacttgggcagggcaactttggccactaatccaactctcttcatttttctggtacttgacatcttggccatgcaaagttccgttgcaacaataggtattcttatttgggcgcagttaggtgatccagtgctcattcgctcatccttacatgtggctttgcccttactgctttttgctttactctgcatgcccttggcattcctttttggcgtggtcactgcagttgggcatgtgaaatggcttgtagtcatcatttgcattatatctgttttattcttttcttgggcgatctttgtccttggccctcacgtcatgctacaacggtcatacgtttctcccaagtacgctggtgactttctcgtgacttttatgcagtataaagacataattgggctttttgtgtctttgataaagtttcttttttgtggttgttattaa

SEQ ID NO: 476 - protein, 691 aa, Arabidopsis thaliana
  G2015,AKR domain coordinates 131-454
MDELFVSISSTFSKTSCITDLLLPLELDRIEAQRSTDASHDQQNRTYLPMNIHGSQDFSQSGGDGVTPLTGDTESVPEFLTNLRLSDLYAIRGEDVRMIPEVFSKISDGNKECLEKLRSRGISVARIKSNTGDSILHLAVTWGHLELVKEIVCECPRLLLEQNSSGQTPLHVAAHSGHTTIVEAFVALVTFSSARLCNEESERMNPYVLKDKDGNTALYYAIEGRYFEMAVCLVNANQDAPFLGNKYGVSSLFVAINTGDVSLVKAILKIIGNKDLKGKKSNLESKLQGQKSLAHVALVTQSIGLFFALTSSSCIYSIQICKTSLRREFPPQGGVLDVILDEYPSLMDERDINGWTCLSLAAHIGYYEGVCNLLERSTKAAEKGHENIVEEFIKRCPAKNGKFWISNMLIINKDTEHLGVGQDVDGNTPLHLAVMNWHFKSITWLARSSKILKVRNKNGLRARDIAEREVKPHYIFQERWTLALLLYAIHSRGFESVHSLTKPSVPLDPKNNRDYVNTLLLVAALVATMTFAAGFTIPGGFNSSAPHLGRATLATNPTLFIFLVLDILAMQSSVATIGILIWAQLGDPVLIRSSLHVALPLLLFALLCMPLAFLFGVVTAVGHVKWLVVIICIISVLFFSWAIFVLGPHVMLQRSYVSPKYAGDFLVTFMQYKDIIGLFVSLIKFLFCGCY

SEQ ID NO: 477 - DNA, 2003 bp, Arabidopsis thaliana
  G2018,family:AKR
gcaagctaggaatattttcaggagtgggattttcaatgggaaggccggatgtgcacttggatcgacgagtagcagaaaaccatcaggcaataccaagaaacaatgtcagatccacaccatctctcgatttgtccactctcttcgacgaaaccagtgaaactaagccgatggatccaaagacgatggctgcagtaagagcaggtaaggaaaattacctgagaagtaataacagttacattagtgttgctccaaccttagtgaacgaccgtggaaatacaatacttcatcttgctgcttcatcgggtcacgtaagccttgtgcgttatataatccagaaatgcccaggtttgctactgaagtcaaatatgatgggagaagttgctctccatttggcagcagaagcaggccatctagatgttgtatggaatctaattgatttcataaatgatatatcttgtactaaccttcctgttgcaaaaaggatatattttgctaagaacaaaaaccaagacactgctttgcatgttgctttgaaagggaaacatgaggtggtcgcttcctatttggtctctgcagcgaaatctttgtcttttgttgcaaacagagatgggttttctcccttgtatcttgctattgaagctggacatacaagtcttgtgacaacaatgtgtcacggaacaaatgaattaagttcaaaggttggaggaagatccattgtacatgcagcattgaaggctaataggaaagatatccttgatgctttacttagcaaagatgcaagtcttatcaacttgagagatgaaggaaggacttctctttcttttggagcatccataggatattatcaagggttttcctatcttttcgacaaaaatcgagacaaggtttatgtcagcgatgatgatggcttatttccaactcatatggcggccaagtatggtcatgttcaaattcttgaggaaattcttaagcattgtccagaggcaattgagttgcttgatagagacggtcaaaatattcttcaccttgcggcaaagtatgggaaactcaaagtcatcaagtttatcctaagctgttgtaaggataagaacaagaaaaagttgattaatgaacaagatgtgaatggaaacacaccgttgcatctagccaccataaactggcaccctaaagttgtgagtatgtttacttgggaccatagagttgacctgaaaaaaagaaactacattggtttcacagctttagatgttgctgaggagaacattgattcgagctacatagttcaccagagattgacttggatggctttgatcaatgctggtgcaccaaaaagttctactccaattacagaaaatcttagatcattcaagaagccagatggtggaaagtacaaagatcgagtcaatactcttatgttggttgcaactctagtagccactatgactttcactgcaggattcacattacctggtgggtacaacgactcttttccccacttgggaatggccgttttggccaagagaacggcttttcaagtctttcttgtatgcgacacattggcaatgtactcttctatcataacaatagttgctctcatttgggcacaactcggtgatctttctatcatactcaaagccttcaacatagcacttccatttctcggacttgctcttacatcaatgtcaatagcatttatggctggcacgtatgttgcggtaagccatctccccttgcttggttatttcgttttgggtattggaatcatcttcctattggttttgttgctgctccttgttccttatgtgtctccatatgctcatgcccaaccccttcttcgacacattttctactatccctatttccttaagcttttggctgctggtgacaacaaaaatattgttgatgtgtacactgcatcagatgaatgaagttatagctttctgtttttctaataaaattgtaaccatgtatattttattctggatgttaacgtgttaatcgataaa

SEQ ID NO: 478 - protein, 629 aa, Arabidopsis thaliana
  G2018,AKR domain coordinates 101-416
MGRPDVHLDRRVAENHQAIPRNNVRSTPSLDLSTLFDETSETKPMDPKTMAAVRAGKENYLRSNNSYISVAPTLVNDRGNTILHLAASSGHVSLVRYIIQKCPGLLLKSNMMGEVALHLAAEAGHLDVVWNLIDFINDISCTNLPVAKRIYFAKNKNQDTALHVALKGKHEVVASYLVSAAKSLSFVANRDGFSPLYLAIEAGHTSLVTTMCHGTNELSSKVGGRSIVHAALKANRKDILDALLSKDASLINLRDEGRTSLSFGASIGYYQGFSYLFDKNRDKVYVSDDDGLFPTHMAAKYGHVQILEEILKHCPEAIELLDRDGQNILHLAAKYGKLKVIKFILSCCKDKNKKKLINEQDVNGNTPLHLATINWHPKVVSMFTWDHRVDLKKRNYIGFTALDVAEENIDSSYIVHQRLTWMALINAGAPKSSTPITENLRSFKKPDGGKYKDRVNTLMLVATLVATMTFTAGFTLPGGYNDSFPHLGMAVLAKRTAFQVFLVCDTLAMYSSIITIVALIWAQLGDLSIILKAFNIALPFLGLALTSMSIAFMAGTYVAVSHLPLLGYFVLGIGIIFLLVLLLLLVPYVSPYAHAQPLLRHIFYYPYFLKLLAAGDNKNIVDVYTASDE

SEQ ID NO: 479 - DNA, 1854 bp, Arabidopsis thaliana
  G2020,family:AKR
atggttcgttcacatcttctccgtgccacgccagaagcttctccgcttaaaccggcatcgtctccgtcaaactgcaggttgtcactttctcccgttgaacttagattatattttattagggacgacgacttcaaagtcaaagtcgacattttcaaaacgtcatatcaaaactccctgtttgaattgccgtgttgtgacaagtcagagttccttaccagtctcagattttcggatcttttcaacctccctggtgaatatgtgccgatgaatcctgagatctttagcgcaatgagagcggggaacatagagcttctggaaaagttgaaaagctacgaaacgccaatggcatgtcttaagagcgatggcggagattctgttcttcaccttgctgctgcttcgggtcatcttgaactagtgaagaacataatcactgaatgtccttgtcttttattggagccaaactcgaagtatcagattccgcttcatgtggccgctcgtgctggccgttcagcagttgtgaaggctcttgttgcttctgtattatatttttcacctagagtgcctgaagaagatagggatagactgaatatatatgttctgaaggacatagatggagatactcctctgcatgcggccttgaaagacctccatgaaaaagcagaggagcgcatcagaaaactatccttgtctcaccttattatgcattggcgacgtagcagatgcatttcattttctgatgcatcaacacgccaaatggagacagctgcctgtctagtgaatgcagaccaacatgcctcatttcttgcgaataaagatggaacatctcccttgtatttggcagttgaagctggtaatgtatcacttgtgagagcgatgttgaaccgtcctggtaataaaatccaaggaaaaacctctaccttagcttcacaattggaagggagaaaatcgcttttacacgcagccctcaaggccaaaaatacagatgttcttaatgttattcttaatgatgacccgagccttgtcaacgagcgagatgaagaagggcgaacttgtctttctgttggagcatccatggggtattacaaaggaatatgtaagctattagatcgatcaacaaagagtgtttatgaatgcgacaaagatggttcctttccaattcatatggctgtagagaaaggtcatttgaaagttgtgaaagagattctaaaacgttgtccagattcgaaagagctggttaacaaacaaggtcaaaacatgcttcacattgcagcaaagagtgcgaaagtgggatcttttcttttgggttatataaggagacttgatacggagaatcatctgatcgaggagcaagatgtggatgggaatgcacctttgcacctagccaccataaattggcgctgtcgaactgttgataaacttgctgcctttgcttctaccgaaacaaaaatcctgaatatacagaacaaagatggattgagacctctggatattgcagagttaaatctacagcctgactacgttttacgggagagattgacgttgatggtactgctgtgcgtttacgcaccgaaaagtgttggttggctaccgacgagtggaatgacactaagaagcagatcagagcctctagacgctaaaaaatacaaagaccatatcaacgctcttctgctggtggcaactcttgtagccactgttacatttgctgcaggttttacaatacctggtggctttaacagctctgctccaaacatgggtatggccactttggccgatgactccaccctcttcttttttctggtattagacaccttggcgatgcaaagctctattgtagcaatagttgctctgatttag

SEQ ID NO: 480 - protein, 617 aa, Arabidopsis thaliana
  G2020,AKR domain coordinates 122-486
MVRSHLLRATPEASPLKPASSPSNCRLSLSPVELRLYFIRDDDFKVKVDIFKTSYQNSLFELPCCDKSEFLTSLRFSDLFNLPGEYVPMNPEIFSAMRAGNIELLEKLKSYETPMACLKSDGGDSVLHLAAASGHLELVKNIITECPCLLLEPNSKYQIPLHVAARAGRSAVVKALVASVLYFSPRVPEEDRDRLNIYVLKDIDGDTPLHAALKDLHEKAEERIRKLSLSHLIMHWRRSRCISFSDASTRQMETAACLVNADQHASFLANKDGTSPLYLAVEAGNVSLVRAMLNRPGNKIQGKTSTLASQLEGRKSLLHAALKAKNTDVLNVILNDDPSLVNERDEEGRTCLSVGASMGYYKGICKLLDRSTKSVYECDKDGSFPIHMAVEKGHLKVVKEILKRCPDSKELVNKQGQNMLHIAAKSAKVGSFLLGYIRRLDTENHLIEEQDVDGNAPLHLATINWRCRTVDKLAAFASTETKILNIQNKDGLRPLDIAELNLQPDYVLRERLTLMVLLCVYAPKSVGWLPTSGMTLRSRSEPLDAKKYKDHINALLLVATLVATVTFAAGFTIPGGFNSSAPNMGMATLADDSTLFFFLVLDTLAMQSSIVAIVALI

SEQ ID NO: 481 - DNA, 900 bp, Arabidopsis thaliana
  G204,family:MYB-related
atgggtgcaccaaagcagaagtggacaccggaagaagaagcagctcttaaagctggagttcttaagcatgggactgggaagtggcgtaccatactctcggatactgagtttagtttaatccttaagtctcgctctaatgttgatcttaaggacaaatggagaaatataagcgtgacagctttatggggttcaaggaagaaggctaaacttgcgcttaagaggactccaccaggtactaaacaggatgataacaacacagctcttaccattgtggctttgactaatgatgatgaacgtgcaaaaccaacttcccccggaggttctggtggtggatcaccacgcacttgtgcttctaagagatcaattacaagtttggataagatcatctttgaggcaattaccaacttgagggaactacgcggttctgacagaacatcaatctttctgtatatagaggagaatttcaagactccaccgaatatgaaaaggcatgtcgcagtacgattaaagcatttatcatcgaatggaacattagttaagataaagcacaagtacaggttttcttctaattttattcccgcaggtgcaagacagaaggctcctcaactctttctggaaggaaacaacaagaaagacccaacaaaacccgaggagaacggtgccaacagtctcactaaattccgagtagacggtgaattatatatgataaaaggcatgacagctcaagaagctgcagaggctgcagcaagagcagttgcagaggcagaatttgctatcacagaggctgaacaagcagcaaaagaggcagaaagagcagaagcagaagctgaagctgctcagatatttgcaaaggcagccatgaaagctttgaagttcaggatccgtaatcatccttggtga

SEQ ID NO: 482 - protein, 299 aa, Arabidopsis thaliana
  G204,MYB-related domain coordinates 6-54
MGAPKQKWTPEEEAALKAGVLKHGTGKWRTILSDTEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 483 - DNA, 1029 bp, Arabidopsis thaliana
  G2053,family:NAC
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 484 - protein, 342 aa, Arabidopsis thaliana
  G2053,NAC domain coordinates 6-152
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 485 - DNA, 1307 bp, Arabidopsis thaliana
  G2057,family:TEO
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 486 - protein, 420 aa, Arabidopsis thaliana
  G2057,TEO domain coordinates 46-103
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 487 - DNA, 1270 bp, Arabidopsis thaliana
  G2059,family:AP2
ttaagaacaggcttcattctctggacaaacactcaaaaaacaaacaaaaaaaggaacatggaagatcagtttcctaaaatagaaactagcttcatgcacgacaagctcttgtcttctggaatctacgggttcttgagttcttcgacgccgccacaacttctcggtgttccaatatttttggaaggtatgaaatctcctcttcttcctgcttcttcgactccgagctactttgtgtcgcctcatgatcatgagctcacatcttctattcatccatctccggtagcttctgttccttggaactttctagaatcttttcctcagtctcaacatcctgatcatcatccttctaaacctccaaaccttactttgttccttaaagaaccaaagctactagaactttctcaatccgaaagcaacatgagcccttaccataaatacatcccaaactccttttatcaatcagaccaaaacagaaacgaatgggtagagatcaataaaactctaaccaactatccctcgaaaggttttggaaactattggctaagtaccaccaagactcaacccatgaagtcaaaaacaagaaaggttgttcagacgacgaccccaacaaaactgtatagaggagtgagacaaagacactggggcaaatgggtcgcagagattaggcttccaaggaacagaacccgtgtttggctcggcacttttgaaaccgctgagcaagcagcaatggcttacgatacagcagcttatatccttcgtggcgaattcgcacacctcaactttcctgatcttaaacaccagctcaagtccggttctttgcgatgcatgatcgcctcacttttggagtccaagattcaacagatctcatcttcccaagtaagtaactctccttctcctcctcctccaaaagtgggaacaccggagcaaaagaatcatcacatgaagatggagtcaggagaagacgtgatgatgaagaaacagaaaagccataaggaagtgatggaaggagatggtgtacaattgagtaggatgccttctttggatatggatctcatttgggatgctctctcatttcctcattcttcttgacttcaaattaatatttgtcaaacttattttacttacttctacccttttttatatcaaaagtttccaccaaagaaagaaattcatattatgatgccaagattggtttgcatttggggttgaacacattgtaattcttcttacgaccacataatcaagtggttctcctttttttgtctgctaa

SEQ ID NO: 488 - protein, 343 aa, Arabidopsis thaliana
  G2059,AP2 domain coordinates 184-251
MEDQFPKIETSFMHDKLLSSGIYGFLSSSTPPQLLGVPIFLEGMKSPLLPASSTPSYFVSPHDHELTSSIHPSPVASVPWNFLESFPQSQHPDHHPSKPPNLTLFLKEPKLLELSQSESNMSPYHKYIPNSFYQSDQNRNEWVEINKTLTNYPSKGFGNYWLSTTKTQPMKSKTRKVVQTTTPTKLYRGVRQRHWGKWVAEIRLPRNRTRVWLGTFETAEQAAMAYDTAAYILRGEFAHLNFPDLKHQLKSGSLRCMIASLLESKIQQISSSQVSNSPSPPPPKVGTPEQKNHHMKMESGEDVMMKKQKSHKEVMEGDGVQLSRMPSLDMDLIWDALSFPHSS

SEQ ID NO: 489 - DNA, 741 bp, Arabidopsis thaliana
  G206,family:MYB-(R1)R2R3
atggggagaagaccatgctgtgagaagataggattgaagaaagggccatggagtgctgaagaagatcgaatcttgatcaattatattagtctccatggccatcccaattggagagctctccctaaactagccgggctacttcggtgcggaaaaagttgcaggcttcgttggattaattatttgagaccagacatcaaacgtggcaatttcactcctcatgaagaagatactatcatcagcttacatcaactcttaggcaacagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgacggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 490 - protein, 246 aa, Arabidopsis thaliana
  G206,MYB-(R1)R2R3 domain coordinates 13-116
MGRRPCCEKIGLKKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRLHHSQDQNNKEDFVSTTAAEMPTSPQQQSSSSADISAITTLGNNNDISNSNKDSATSSEDVLAIIDESFWSEVVLTDCDISGNEKNEKKIENWEGSLDRNDKGYNHDMEFWFDHLTSSSCIIGEMSDISEF

SEQ ID NO: 491 - DNA, 1116 bp, Arabidopsis thaliana
  G2061,family:MADS
atgacaagaaagaaagtaaaacttgtatggatcgagaatgacaagtcaagagcaacaagtttgcaaaaaatgagggtaggattacttaaaaaggtgaaagagctaaccatattgtgtgctgtaagggctattgtaatcattttcagccccgataaggttggaccattggtgtggccatctcctcaggcgactcatggtctcctagacgaatttttcgctttaccgaagtccgtgcagaagaagaaagagtcaaatgtcgaatcctacctaaaagagaagacacataagtttcaagaacaattgaagaagagtaaaaagaagaacaaggagcatgtcattgatgagctgatgatgcaactccaaagcggtcgtgaaattgctgatcttaaccaaagtgagatgtatgccttgttatctttctcaagagatactatcctactttgtaggaagaaactagctttcatgcaatttcctcctcttcgcgatccaccagtgtttccatttgaaatacaagtcgaagagttcaaaaccaccacaaatgatggttttgtaggaggcggtcaagataataaaagagctggaaggacagatgaagcaacaagattcatcaacaccgatatatttaagcagagtaaaagttattacttttttgatgaatgggtttttccacctagtccacctaaatatgaaataccgcaacaaatggagaacggaaatccaaaccctaaaagctatcgtctttatcaaggaagcagtagcaacggaaaccctcatttggaaatggatccatttcgtctccaaatgatgacttcccaaggtttggctgggtcagtctcccaacctttacaacatcacagcatgatcaataatccaacaatggctatgaatcaaccaagccaagatccttttgattacatgagaagtgagctgggaataaacgaaggaatcaacattaacaactcacaattttacatgagcaacaacactataacggctaatgatggtgttcgccaagaaccatatcctaatgtaacaaccgctggagaaaacaatggtgatgcgacgacgtctaataccaacatggtgtggccgggttttaacaatcatcatttctaa

SEQ ID NO: 492 - protein, 371 aa, Arabidopsis thaliana
  G2061,MADS domain coordinates 1-57
MTRKKVKLVWIENDKSRATSLQKMRVGLLKKVKELTILCAVRAIVIIFSPDKVGPLVWPSPQATHGLLDEFFALPKSVQKKKESNVESYLKEKTHKFQEQLKKSKKKNKEHVIDELMMQLQSGREIADLNQSEMYALLSFSRDTILLCRKKLAFMQFPPLRDPPVFPFEIQVEEFKTTTNDGFVGGGQDNKRAGRTDEATRFINTDIFKQSKSYYFFDEWVFPPSPPKYEIPQQMENGNPNPKSYRLYQGSSSNGNPHLEMDPFRLQMMTSQGLAGSVSQPLQHHSMINNPTMAMNQPSQDPFDYMRSELGINEGININNSQFYMSNNTITANDGVRQEPYPNVTTAGENNGDATTSNTNMVWPGFNNHHF

SEQ ID NO: 493 - DNA, 625 bp, Arabidopsis thaliana
  G2062,family:MADS
tttataaccaataaactcataattttgtttttctccaaaatgaatcccaagaaaaccaaaggaaaacaaaagattaacatcaagaaaattgaaaaagacgaagacagatcggtcacattgtctaagcgtctaaatgctatctacactatgatcattgagctttccattctctgtggtgttgaagttgcgtttatcgggtattcttgctctggaaaaccatacacattcggcagtccgtccttccaagccgtggtggagcggtttctcaacggcgaggcctcgtcgtcttcttcatcatcgttgcaacgatcggtcaagaatgctcacaagcaagcgaagattcaagagctttgcaaaagatacaatagattggtggaggagttaaaggtggacgaagtcaaagtcaagaaggcagctgcattggcggagacgagggccgtgaataaggatgcgtggtggaaagcagatccaaatgacgtgaaggatcacgaaaaggcgaagaagatgatggagaagtatcaagagctcaaagagaaactgcgtgaggaagttgctttaaggatcaagagaggacatgatgagaataataacaaatgatctgtaatcaagattttaattagtagat

SEQ ID NO: 494 - protein, 185 aa, Arabidopsis thaliana
  G2062,MADS domain coordinates 8-63
MNPKKTKGKQKINIKKIEKDEDRSVTLSKRLNAIYTMIIELSILCGVEVAFIGYSCSGKPYTFGSPSFQAVVERFLNGEASSSSSSSLQRSVKNAHKQAKIQELCKRYNRLVEELKVDEVKVKKAAALAETRAVNKDAWWKADPNDVKDHEKAKKMMEKYQELKEKLREEVALRIKRGHDENNNK

SEQ ID NO: 495 - DNA, 549 bp, Arabidopsis thaliana
  G2063,family:MADS
atgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatga

SEQ ID NO: 496 - protein, 182 aa, Arabidopsis thaliana
  G2063,MADS domain coordinates 7-63
MNPKKTKGKQKINIKKIEKDEGRSVTFSKRLNGIYTKISELSILCGVEVAFIGYSCSGKPYTFGSPSFQAVAERFLNGDASSSSSSSLVMNAHKQAKIQELCKKYNRLVEELKVDEVKVKKAAALAETRVVNKDVWWKVDPNDVKDHEKAKKMMEKYQELYDKLCEQAASRIKRGHDENNNK

SEQ ID NO: 497 - DNA, 1766 bp, Arabidopsis thaliana
  G2068,family:bZIP
caacgatgaacggtcgtggaaatatgactcaataccagcagaatcctttcagtactgatgatggtggccagagcaccggcgtgtcactctcttcccggacttctctgtcaccaccactgatccgttatccagccgggtcgccggacttcagccccggaccacggtgtacgactcaaccgtcccctaccttctccgacttcactcaagcgagtccttcactgacgtcattcaataatccggcaagctttacaccttcgtttagcttctccaacattcaccaaatgattcctacgccgtcgtcgtcccataactcaaaggcgtcggtgagctctgcttcgtcgtctagcttctactttccccagacgagtccttcatcatgctctactccgtcgtcgttcagtccagactcgttttctcactccaacaccggaccatggtcgatccctcagccttcccctgtgttctcatccatagcaccggccagttctgctctgtcgtcgttcggtccagactcattttctcactccaacaccggaacatggtcgatccctcagccttcccctgtgttctcatccatagcaccggccagctctgctccgccgttgttcggtcgtgattcatttccccgctccaaccgcggaaaagggtcgttgattcataggtcgcctgtgctttcggtcttaccgccggcgcctgtctactcctctaatccgatggtgagatcatctccgccgggtcacccatctccatcagcacatttggaggaaatgtctaaccgtcccccgttgcatcctcagcctcgggttccagtcacgaggtccaactctgcgaaagtctccggtagcaggcctagaaagtatcataaaaggaccaacagtgagctatcaagtatgttggttggggactcaagccgcggcgaggaaggcggatttggaaagctcatatataatgaggaagcaatgaaggaattctgctctgagtatatgatcatgcctaaccaaagtgctgttaacaatagtgatcagaatcggaatgctgatgttttgatgataaccaatactgattcgggaggtgcaaatgatgctaagaaatataaaagaatgttggcaaaccgagcctcagctgcacgttctaaggagaatcgggaaaagaagattcgtgatatggaactcagagtagaaactcttgaaaacactcaagcttcactgtttggaacgatgacacttttggagaaggaaaacatagtgatgatgaacgagaataagttagcgaagattcgacttcaattactagagcaacaggcccctcttcttactgctttcattttttttgtttttgtagctttaactaaacaattagatgaactccgaaggctagaaaaggaggcaaatgaacgagggagtgtcgactattctcaactactgaaacaactgaaacaaagtgaagagctccttgctgaaatcaaccgatttaaagtagcaactggtcaggggatgaaaaatcccaaccagttcgagggttcaaccatgcatcaatcggaccaaaacgtgttccagccgcaactcaacacctatgagttcaatcagcaccagcaattggacccaaacatattcaaagagcaatgcaatgtcaacgagtttaatcatgagcaaccaaaccatgaattttatggacataactaaaggattaaacatgtcttcaagttgttttagatttatctatatatgattataaatttgtaaccgtgagagggttcagacaatatg

SEQ ID NO: 498 - protein, 558 aa, Arabidopsis thaliana
  G2068,bZIP domain coordinates 338-455
MNGRGNMTQYQQNPFSTDDGGQSTGVSLSSRTSLSPPLIRYPAGSPDFSPGPRCTTQPSPTFSDFTQASPSLTSFNNPASFTPSFSFSNIHQMIPTPSSSHNSKASVSSASSSSFYFPQTSPSSCSTPSSFSPDSFSHSNTGPWSIPQPSPVFSSIAPASSALSSFGPDSFSHSNTGTWSIPQPSPVFSSIAPASSAPPLFGRDSFPRSNRGKGSLIHRSPVLSVLPPAPVYSSNPMVRSSPPGHPSPSAHLEEMSNRPPLHPQPRVPVTRSNSAKVSGSRPRKYHKRTNSELSSMLVGDSSRGEEGGFGKLIYNEEAMKEFCSEYMIMPNQSAVNNSDQNRNADVLMITNTDSGGANDAKKYKRMLANRASAARSKENREKKIRDMELRVETLENTQASLFGTMTLLEKENIVMMNENKLAKIRLQLLEQQAPLLTAFIFFVFVALTKQLDELRRLEKEANERGSVDYSQLLKQLKQSEELLAEINRFKVATGQGMKNPNQFEGSTMHQSDQNVFQPQLNTYEFNQHQQLDPNIFKEQCNVNEFNHEQPNHEFYGHN

SEQ ID NO: 499 - DNA, 1482 bp, Arabidopsis thaliana
  G2071,family:bZIP
taggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggtttacagaggcaaggctccttgaccttgcctagaacgcttagtcagaagactgtcgatgaagtctggaaatacctgaattcgaaagaaggtagtaatgggaatactggaacggatgcgcttgagaggcaacagactttaggggaaatgactctggaagatttcttactccgtgctggcgttgttaaagaagataatactcagcagaacgaaaacagtagtagcgggttttatgctaacaacggtgctgctggtttggagtttggatttggtcagccgaatcaaaacagcatatcgttcaacgggaacaatagttctatgatcatgaatcaagcacctggtttaggcctcaaagttggtggaaccatgcagcagcagcagcagccacatcagcagcagttgcagcagccacatcagagactgcctccaactatctttccaaaacaagcgaatgtaacatttgcggcgcctgtaaatatggtcaacaggggtttatttgagactagcgcagatggtccagccaacagtaatatgggaggagcagggggtactgttacagctacttctcctgggacgagcagtgcagaaaacaatacttggtcatcaccagttccttacgtgtttggtcggggaagaagaagcaatacgggcctggagaaggttgttgagagaaggcaaaagagaatgatcaagaatcgggaatccgctgctagatcaagggctcgaaaacaggcttataccttggaattggaagctgagattgaaagtctcaagctagtgaatcaagatttgcagaagaaacaggctgaaataatgaaaacccataatagtgagctaaaggaattttcgaagcagcctccattgctggccaaaagacaatgcttgagaagaacccttaccggtccgtggtaagaaggtgaagtcaaagcaagaagaacctgctaatgtaatacaggaccactcaaaaggaagacactgggagagtaatatgtaatagaagatagtgctactgtacaggagaaattacagagacgcttacaatgtagaaatcttttgagctgaatttaactaagagtgcagtctgtgtagagtatgagagctttcaatatgaattcataattttcataa

SEQ ID NO: 500 - protein, 392 aa, Arabidopsis thaliana
  G2071,bZIP domain coordinates 307-358
MGTHIDINNLGGDTSRGNESKPLARQSSLYSLTFDELQSTLGEPGKDFGSMNMDELLKNIWTAEDTQAFMTTTSSVAAPGPSGFVPGGNGLQRQGSLTLPRTLSQKTVDEVWKYLNSKEGSNGNTGTDALERQQTLGEMTLEDFLLRAGVVKEDNTQQNENSSSGFYANNGAAGLEFGFGQPNQNSISFNGNNSSMIMNQAPGLGLKVGGTMQQQQQPHQQQLQQPHQRLPPTIFPKQANVTFAAPVNMVNRGLFETSADGPANSNMGGAGGTVTATSPGTSSAENNTWSSPVPYVFGRGRRSNTGLEKVVERRQKRMIKNRESAARSRARKQAYTLELEAEIESLKLVNQDLQKKQAEIMKTHNSELKEFSKQPPLLAKRQCLRRTLTGPW

SEQ ID NO: 501 - DNA, 1099 bp, Arabidopsis thaliana
  G2072,family:bZIP
tcgacccacgcgtccgcccacgcgtccggatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacatcaaaatgctcatcgagcgcgtttgagaaggcttgagtacatatcagaccttgaaaggaccatccaagtgctacaagttgaaggatgtgaaatgtcatctgccattcactacttggatcagcagttactcatgcttagcatggaaaatagagctttaaaacaacgtatggatagtttagcagaaatccaaaagcttaaacatgtggagcagcaattgcttgagagagagataggaaacctacagtttcgacgacaccaacaacaaccacagcaaaaccaaaaacaagtccaagcaatacaaaatcgatacaccaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaacctaaaaaagcatcgttatgtaaatcaaaatgtggttgcccatatcctcctctattgcatttctctctatttatggcatggtagagaatctcttgtcaagaaacttcatgttatgtaataacttgtaatccttcttatttcatctattatatatatgaataagtaatttttttgccaaaaaaaaaaaaaaaaaaaaaaaa

SEQ ID NO: 502 - protein, 212 aa, Arabidopsis thaliana
  G2072,bZIP domain coordinates 90-149
MPSKENHVAGSSWQFQNYDLWQSNSYEQHNKLGWDFSTANGTNIQRNMSCGALNMSSKPIEKHVSKMKEGTSTKPDGPRSKTDSKRIKHQNAHRARLRRLEYISDLERTIQVLQVEGCEMSSAIHYLDQQLLMLSMENRALKQRMDSLAEIQKLKHVEQQLLEREIGNLQFRRHQQQPQQNQKQVQAIQNRYTKYQPPVTQEPDAQFAALAI

SEQ ID NO: 503 - DNA, 780 bp, Arabidopsis thaliana
  G2084,family:RING/C3HC4
atgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatga

SEQ ID NO: 504 - protein, 259 aa, Arabidopsis thaliana
  G2084,RING/C3HC4 domain coordinates 41-172
MHKERGKMPVSSNRNRVSPYPLRSCRNKKQKEVEASSSPVELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQHMWEQLEREAEYIEMLNARQRWDAEQRLLATSLHQLPYRHPMIDLNFDALVHNLFLGASMESRASTDNYPAHIPRLEFHAPMYPRWTP

SEQ ID NO: 505 - DNA, 1119 bp, Arabidopsis thaliana
  G2085,family:GATA/Zn
gttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatctcag

SEQ ID NO: 506 - protein, 309 aa, Arabidopsis thaliana
  G2085,GATA/Zn domain coordinates 214-241
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 507 - DNA, 932 bp, Arabidopsis thaliana
  G2086,family:RING/C3HC4
atgctaaactgttcagtgtccccaaatctttttgcaacttctttcttcttcatattcttctcaccgtgaaggcgtcgtcaccgccgatgttattatctccggcgatgttttctgatcatcactgctttactcttactgcgagaatgtcagattctgatgaagctaaaacgtcggaggaagaatctcaacttgctgagcaagaaacagagactcaagaaggtgaaatgactaaaaacttaaagaaaagagatcttgatgcagtagaagatgaagattcgaataacgaaagctccagattagagaaactagagaagaagataaaaaaagaaacagcgaggaagcttgaaactgactttgtgctaacaggggaagaggatgatgatgcattgcccttagcctgttccatttgccaaaacccattcttggatcctgttgtcaccaactgcaaccattacttctgcgacaagtgtgctctaaagcatcacactgagaacgatacttgttttgtgtgtaacgagccaactctagggcttttcgacacagccgtggagatcaaggaaagaatagaggaagaacgtgagaaagccagagccatggtaaaggaagtgacagcaatgttagaaaaggcatcgacaatggcggatgacgccaagggcgtagcgcaaaaggttgtaaaaatggtggaggagattgaaacaatggtggaaaaagtggcggctatggccacaaaggcgggagaaacggcgacaatggcggcagatatggtgaaagaagctgaggagacgatggaaacagctaaagctaatatgtccaaagcctttgtggtaatgaagtcggtgaattggaacgtgtaaatcgggtcaaaacagagttttattgtgatctcatgctgacatcagctacaatctttatctaataagatagattctcac

SEQ ID NO: 508 - protein, 255 aa, Arabidopsis thaliana
  G2086,RING/C3HC4 domain coordinates 83-131
MLLSPAMFSDHHCFTLTARMSDSDEAKTSEEESQLAEQETETQEGEMTKNLKKRDLDAVEDEDSNNESSRLEKLEKKIKKETARKLETDFVLTGEEDDDALPLACSICQNPFLDPVVTNCNHYFCDKCALKHHTENDTCFVCNEPTLGLFDTAVEIKERIEEEREKARAMVKEVTAMLEKASTMADDAKGVAQKVVKMVEEIETMVEKVAAMATKAGETATMAADMVKEAEETMETAKANMSKAFVVMKSVNWNV

SEQ ID NO: 509 - DNA, 918 bp, Arabidopsis thaliana
  G209,family:MYB-related
tcaacccaccagtccaagtcaaacctcctcaagccatcccctaatcctatatatcagtttcttctcgcaaaccacctcacaatctatcaacagttttaaaaaaagacataactcaaccaatctcactttgaaaaagacatgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttgtagacgccacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccgctctttgccttcaggactctagcgaatcctctaccaatggttcaacaggtcaagaaacgcttcttctattccgatgagaaatggtgtatttctttgtacacatttgttatattacaaatgcacatattataatattcactagagagatggtataacgatgtttgaaatatgttaatcctgaattggaccggctggtcattgaacaactattctcttaaatgtccggttctgttttcagtgattagtattatagtagatcgttaataacta

SEQ ID NO: 510 - protein, 213 aa, Arabidopsis thaliana
  G209,MYB-related domain coordinates 36-82
MNKTRLRALSPPSGMQHRKRCRLRGRNYVRPEVKQRNFSKDEDDLILKLHALLGNRWSLIAGRLPGRTDNEVRIHWETYLKRKLVKMGIDPTNHRLHHHTNYICRRHLHSSHKEHETKIISDQSSSVSESCGVTILPIPSTNCSEDSTSTGRSHLPDLNIGLIPAVTSLPLFAFRTLANPLPMVQQVKKRFFYSDEKWCISLYTFVILQMHIL

SEQ ID NO: 511 - DNA, 1156 bp, Arabidopsis thaliana
  G2092,family:RING/C3HC4
aaacatgccgaaagagaggaaagaacggtccgtatctcttgataagtataaacgatcgccactgtgttgtgaggcaagccttgctttgaagccgagtgagaaacaagttaaggaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagaagaagaagaagtagtagtagaagaagaagaagaaggaattgtaacaacagaagaagatcaagaaaaaaacaaaccacaaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgaacaagtgtctggaactcggagacgtcgttctagaagaagaactgtcattgatgatgatgatgaagaagaagaaccgtgatgctctgcagtttggaaatttggtctttggagt

SEQ ID NO: 512 - protein, 372 aa, Arabidopsis thaliana
  G2092,RING/C3HC4 domain coordinates 176-208
MPKERKERSVSLDKYKRSPLCCEASLALKPSEKQVKEWEEARCPVCMEHPHNGILLICSSYENGCRPYMCDTSHRHSNCFDQFRKASKEKPSLSLLREEEESNEPTEMEDVDSDSTAVNLLGEAASEITVVDLSDGERGEEEVEEEEEEVVVEEEEEGIVTTEEDQEKNKPQKLTCPLCRGHIKEWVVVKAARCFMNSKHRSCSCETCDFSGSYSDLRKHARLLHPGVRPSEADPERQRSWRRLERQSDLGDLLSTLQSSFGGDEISNDDGFLFADTRLLTVYFLIRVFRPESSGSRSSSWSGTSRARTHTSGRRRSSRPASLWGESYEGNTGTSPRDEENNQSSDEQVSGTRRRRSRRRTVIDDDDEEEEP

SEQ ID NO: 513 - DNA, 450 bp, Arabidopsis thaliana
  G2094,family:GATA/Zn
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 514 - protein, 149 aa, Arabidopsis thaliana
  G2094,GATA/Zn domain coordinates 43-68
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 515 - DNA, 1003 bp, Arabidopsis thaliana
  G21,family:AP2
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 516 - protein, 295 aa, Arabidopsis thaliana
  G21,AP2 domain coordinates 97-164
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 517 - DNA, 1252 bp, Arabidopsis thaliana
  G210,family:MYB-(R1)R2R3
tcagaacacaaaagtttggctacagttgtgttctgatagtgatgatcatgatcatcacatgaataagtagaagatatctcttaccttctccttcttctaataagatcagagttttggttcttatttctttgacctctcaaaacaatgggtagatcaccgtgttgtgacaaattgggtttgaagaaaggaccttggacaccagaggaggatcagaaacttttagcttatattgaagaacatggtcatggaagttggcgttcattgcctgagaaagctggtctccatcgatgcggaaagagttgtagactaagatggactaactacctaagacctgacatcaaaagaggcaaattcaacttacaagaagaacaaaccattatccaactccatgctctgttaggaaacagatggtcagcgattgctactcatttgccaaagagaacagacaacgagatcaagaactattggaacactcatttgaagaaacggttagtgaaaatggggattgatccagtgactcataaacccaaaaacgagactcctttatcttctcttggtctatccaagaacgcagctatacttagccacactgctcaatgggaaagtgcaaggcttgaagctgaagcaagactagctagagaatcaaagcttcttcatttacaacattaccaaaccaaaacatcatctcaacctcatcatcatcatggattcactcacaagtcattgttacctaattggacaacaaaaccacacgaagatcaacaacagcttgaatctccgacatctacagtgtcattctctgagatgaaggaatcaatcccggcgaagatagagtttgtcggatcatcaactggtgtgactctgatgaaagaacctgaacacgattggatcaattcaacgatgcacgagtttgaaactacgcagatgggagaaggaatcgaagaagggttcacgggtctcttgctcggtggtgattcaatcgaccggagtttttccggcgataaaaacgagacggccggcgagagtagtggtggtgactgcaactactatgaggacaacaagaactacttggacagcattttcaactttgtagatccttcaccgtcggattcaccgatgttctgaatctaagggttgatatttgttgggaatgtttttgattctttttttagtttctagtttttgtgcttaaactctgattagacaatttttaaactaatccaatttttgcgctaaaaaaaaaaaaaaaaaa

SEQ ID NO: 518 - protein, 326 aa, Arabidopsis thaliana
  G210,MYB-(R1)R2R3 domain coordinates 14-114
MGRSPCCDKLGLKKGPWTPEEDQKLLAYIEEHGHGSWRSLPEKAGLHRCGKSCRLRWTNYLRPDIKRGKFNLQEEQTIIQLHALLGNRWSAIATHLPKRTDNEIKNYWNTHLKKRLVKMGIDPVTHKPKNETPLSSLGLSKNAAILSHTAQWESARLEAEARLARESKLLHLQHYQTKTSSQPHHHHGFTHKSLLPNWTTKPHEDQQQLESPTSTVSFSEMKESIPAKIEFVGSSTGVTLMKEPEHDWINSTMHEFETTQMGEGIEEGFTGLLLGGDSIDRSFSGDKNETAGESSGGDCNYYEDNKNYLDSIFNFVDPSPSDSPMF

SEQ ID NO: 519 - DNA, 1536 bp, Arabidopsis thaliana
  G2105,family:TH
ctctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgat

SEQ ID NO: 520 - protein, 481 aa, Arabidopsis thaliana
  G2105,TH domain coordinates 100-153
MEDHQNHPQYGIEQPSSQFSSDLFGFNLVSAPDQHHRLHFTDHEISLLPRGIQGLTVAGNNSNTITTIQSGGCVGGFSGFTDGGGTGRWPRQETLMLLEVRSRLDHKFKEANQKGPLWDEVSRIMSEEHGYTRSGKKCREKFENLYKYYKKTKEGKSGRRQDGKNYRFFRQLEAIYGESKDSVSCYNNTQFIMTNALHSNFRASNIHNIVPHHQNPLMTNTNTQSQSLSISNNFNSSSDLDLTSSSEGNETTKREGMHWKEKIKEFIGVHMERLIEKQDFWLEKLMKIVEDKEHQRMLREEEWRRIEAERIDKERSFWTKERERIEARDVAVINALQYLTGRALIRPDSSSPTERINGNGSDKMMADNEFADEGNKGKMDKKQMNKKRKEKWSSHGGNHPRTKENMMIYNNQETKINDFCRDDDQCHHEGYSPSNSKNAGTPSCSNAMAASTKCFPLLEGEGDQNLWEGYGLKQRKENNHQ

SEQ ID NO: 521 - DNA, 845 bp, Arabidopsis thaliana
  G2107,family:AP2
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 522 - protein, 181 aa, Arabidopsis thaliana
  G2107,AP2 domain coordinates 27-94
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 523 - DNA, 722 bp, Arabidopsis thaliana
  G2108,family:AP2
gagagagaaacattgatctctgaatattgtgaacatgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtgagcttgtattaccgatccttcaatttatg

SEQ ID NO: 524 - protein, 219 aa, Arabidopsis thaliana
  G2108,AP2 domain coordinates 18-85
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 525 - DNA, 1428 bp, Arabidopsis thaliana
  G2109,family:MADS
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatcaatatattaatgtttttaaaaaaaaaa

SEQ ID NO: 526 - protein, 380 aa, Arabidopsis thaliana
  G2109,MADS domain coordinates 1-57
MGRVKLKIKRLESTSNRQVTYTKRKNGILKKAKELSILCDIDIVLLMFSPTGRATAFHGEHSCIEEVISKFAQLTPQERTKRKLESLEALKKTFKKLDHDVNIHDFLGARNQTIEGLSNQVAIYQAQLMECHRRLSCWTNIDRIENTEHLDLLEESLRKSIERIQIHKEHYRKNQLLPIECATTQFHSGIQLPMAMGGNSSMQEAHSMSWLPDNDHQQTILPGDSSFLPHREMDGSIPVYSSCFFESTKPEDQICSNPGQQFEQLEQQGNGCLGLQQLGEEYSYPTPFGTTLGMEEDQEKKIKSEMELNNLQQQQQQQQQQQQQDPSMYDPMANNNGGCFQIPHDQSMFVNDHHHHHHHHHQNWVPDSMFGQTSYNQQPN

SEQ ID NO: 527 - DNA, 750 bp, Arabidopsis thaliana
  G211,family:MYB-(R1)R2R3
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 528 - protein, 249 aa, Arabidopsis thaliana
  G211,MYB-(R1)R2R3 domain coordinates 24-137
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 529 - DNA, 1148 bp, Arabidopsis thaliana
  G2116,family:bZIP
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctg

SEQ ID NO: 530 - protein, 337 aa, Arabidopsis thaliana
  G2116,bZIP domain coordinates 150-210
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 531 - DNA, 506 bp, Arabidopsis thaliana
  G2117,family:bZIP
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 532 - protein, 138 aa, Arabidopsis thaliana
  G2117,bZIP domain coordinates 46-106
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 533 - DNA, 1511 bp, Arabidopsis thaliana
  G2121,family:VAR
aacacttttcttgttgtgagagtaagagggaggttaaaatgagcataatgaggaatttcttgagtatgataattatgctttgcgtatgtctcaattggtgttttgctgaaggagctgagaaaagcgatagtggaaaggtacttgattcttacaccattcaagtcagctctctgttcccttcatcatcatcttgtgtcccttcttcaaaagcatctaataccaagtcgtcgctgcgcgtggtgcacatgcatggtgcgtgctcgcatcttagcagcgatgcgagagtcgaccatgacgaaatcatcagacgcgatcaagcacgtgtggagtccatctactcaaaattgtcaaagaatagcgcaaatgaagtcagcgaagccaagtcaacggagctaccggctaaaagtggaatcacactcggatcaggaaactacatcgtaacaatcggaatcgggacaccgaagcacgatctatcgctggtcttcgacaccggaagtgacctgacatggactcaatgtgagccatgtctaggaagttgctattcacaaaaggaaccaaaatttaacccttcttcgtcttctacttaccaaaacgtctcgtgctcatctccaatgtgtgaagacgctgagagttgttcggcttccaactgcgtatacagtatcgtttacggcgataagtcgtttacccaaggatttcttgcaaaggagaaatttaccctaacgaactctgatgttttggaggatgtttactttggttgcggtgaaaacaaccaaggacttttcgacggtgttgctgggcttctcggccttggccctggcaaactctcactaccggcgcaaacaacaacgacctacaacaatatcttctcctactgtctaccttctttcacaagtaacagtactggccatcttacctttggatccgctggaatctctgaatccgttaaattcacaccgatttcttccttcccaagcgcattcaattatggcatcgatatcataggtatcagtgtaggcgacaaggaattagcgattactccaaactcattctcgaccgaaggtgctataatcgactcaggcacagtgtttactcgcctccctaccaaagtctacgcggaactccgcagtgtttttaaggaaaagatgtcgagttacaagagtacgtcgggatacgggctttttgacacatgttacgatttcactggcttggatacggtgacatacccgacgattgcattctccttcgccggtagcactgtcgtagaacttgatggatcagggatttcgttgccgatcaagatatcacaggtttgtttggcgtttgcagggaatgatgaccttcccgccatctttggaaacgttcagcagacgacgctagatgttgtgtacgacgtggctggtggacgagtcggttttgctcccaatggttgttaattagctacttgaacaaaaagaagaggagagggttttgtaatttgagtaagggtttggctcgtaaatttagctcctatt

SEQ ID NO: 534 - protein, 464 aa, Arabidopsis thaliana
  G2121,VAR domain coordinates 130-226
MSIMRNFLSMIIMLCVCLNWCFAEGAEKSDSGKVLDSYTIQVSSLFPSSSSCVPSSKASNTKSSLRVVHMHGACSHLSSDARVDHDEIIRRDQARVESIYSKLSKNSANEVSEAKSTELPAKSGITLGSGNYIVTIGIGTPKHDLSLVFDTGSDLTWTQCEPCLGSCYSQKEPKFNPSSSSTYQNVSCSSPMCEDAESCSASNCVYSIVYGDKSFTQGFLAKEKFTLTNSDVLEDVYFGCGENNQGLFDGVAGLLGLGPGKLSLPAQTTTTYNNIFSYCLPSFTSNSTGHLTFGSAGISESVKFTPISSFPSAFNYGIDIIGISVGDKELAITPNSFSTEGAIIDSGTVFTRLPTKVYAELRSVFKEKMSSYKSTSGYGLFDTCYDFTGLDTVTYPTIAFSFAGSTVVELDGSGISLPIKISQVCLAFAGNDDLPAIFGNVQQTTLDVVYDVAGGRVGFAPNGC

SEQ ID NO: 535 - DNA, 902 bp, Arabidopsis thaliana
  G2129,family:bZIP
actcatttcctcatcttttggtctttctcttttcattcttagaaaaagaaaatttgaaaaaaagataaaaagaaaaagaaaagtaaatctaaaaagttattaggaaaaacccccatcaatattctactaatgtctgaccaaaatagcctcatgtgtgtattctctcgtccataaatatggacctccaacaatgcaattcttcccttttccccttctaatctctctcgcatctctacattttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacggtccagcaagatccgtcgatcatgttatcataagttgaggtttctgaaattgtttcgacggtaaaatgggaacaatttgtaaaaacaatt

SEQ ID NO: 536 - protein, 156 aa, Arabidopsis thaliana
  G2129,bZIP domain coordinates 71-140
MMSTISPVFSTEPGLLTSVLPAFETSFTPWDISHLFSVFDSLIDPKPVSTHDYGSVNQIGSDMSPTDNTDERKKKRKLSNRESAKRSREKKQKHLEEMSIQLNQLKIQNQELKNQLRYVLYHCQRTKMENDRLLMEHRILHDKLLNIRQVLMFRQT

SEQ ID NO: 537 - DNA, 1019 bp, Arabidopsis thaliana
  G2130,family:AP2
cctctcttcattttttaactccctctctctctctctctctatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgattaaaaatctcttcttttttggggaaatttttgtg

SEQ ID NO: 538 - protein, 315 aa, Arabidopsis thaliana
  G2130,AP2 domain coordinates 101-169
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 539 - DNA, 1064 bp, Arabidopsis thaliana
  G2132,family:AP2
attctgttacttagtaccggagtttagtcggagagagaacaatgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatgaatactttcttgacacggccaacggtattagtac

SEQ ID NO: 540 - protein, 329 aa, Arabidopsis thaliana
  G2132,AP2 domain coordinates 84-151
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 541 - DNA, 1047 bp, Arabidopsis thaliana
  G2135,family:AP2
ctttaaaattgagaaattttactttttagcccaaaacttttaaaacttatactttgaaccctttagttctgagaaaatgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctgaacggttctattgtacaaatgacatgagtgttttaaatgagttcttcttcgacttgtctgtttgctatttattcttcaaaccttagccagtgtcaaacaaaaacggccactacgactattgttttgaagattgcgatattttaagttgtaagaatgtagagaataatgtttgggaagaacaaa

SEQ ID NO: 542 - protein, 262 aa, Arabidopsis thaliana
  G2135,AP2 domain coordinates 73-140
MCGGAVISDYIAPEKIARSSGKSSWRSNGVFDCSIYDFDGNFDELESDEPFVFSSTHKHHASGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 543 - DNA, 828 bp, Arabidopsis thaliana
  G2139,family:MADS
cctacaagaaatcaaacactagttctggtttctgcaaacatgtcatctacgaagcaagcaaagggaagaaaaacaaaggggaagcaaaagatcgagatgaagaaggtggagaactatggagataggatgattacgttctcaaaacgtaaaaccggaatttttaagaaaatgaacgagctcgtagcaatgtgtgacgttgaagtggctttcttgattttctctcaacccaagaagccctatacattcgcacatccgtctatgaagaaagtggctgaccggttaaagaacccttcgagacaagaaccattagagagagacgataccagacccctcgtcgaagcttataagaaacgaaggctccacgacctcgtaaaaaaaatggaggcgctcgaagaggagcttgcgatggatctagagaagttgaaactgttgaaggaatcgagaaatgaaaagaagttagataaaatgtggtggaactttccttcggaaggtttgagcgcgaaggagctgcagcaaaggtaccaagcgatgctcgagttacgtgataacttatgcgacaatatggctcacttacgattgggaaaagactgtggtggttcatcttctgttcgtgtgggacgtcgagtttctggtggtgttcgtctgttcgatcgtgaagcatgatcatacatattcatacttgatgatttaaatttctttgtatttgaactgctgattttaatactgcatgtatccatttgacgaagctcaatcgtctcgagtatatctctattatctaacagtattgagaaaaaaggagtttcagtaaaaaaaaaaaaaaaaaaaaaa

SEQ ID NO: 544 - protein, 207 aa, Arabidopsis thaliana
  G2139,MADS domain coordinates 14-69
MSSTKQAKGRKTKGKQKIEMKKVENYGDRMITFSKRKTGIFKKMNELVAMCDVEVAFLIFSQPKKPYTFAHPSMKKVADRLKNPSRQEPLERDDTRPLVEAYKKRRLHDLVKKMEALEEELAMDLEKLKLLKESRNEKKLDKMWWNFPSEGLSAKELQQRYQAMLELRDNLCDNMAHLRLGKDCGGSSSVRVGRRVSGGVRLFDREA

SEQ ID NO: 545 - DNA, 1523 bp, Arabidopsis thaliana
  G2141,family:HLH/MYC
cttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagatagc

SEQ ID NO: 546 - protein, 486 aa, Arabidopsis thaliana
  G2141,HLH/MYC domain coordinates 306-364
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATASLPAANMKVEP

SEQ ID NO: 547 - DNA, 1456 bp, Arabidopsis thaliana
  G2144,family:HLH/MYC
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 548 - protein, 379 aa, Arabidopsis thaliana
  G2144,HLH/MYC domain coordinates 207-265
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 549 - DNA, 777 bp, Arabidopsis thaliana
  G2145,family:HLH/MYC
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 550 - protein, 258 aa, Arabidopsis thaliana
  G2145,HLH/MYC domain coordinates 170-227
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 551 - DNA, 1366 bp, Arabidopsis thaliana
  G2147,family:HLH/MYC
ctgtgattgtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccatatatatagttcttgaaagattgttgtatcatgattgtaaaaactgttttgagtatggaaaaagacttgcagataaaa

SEQ ID NO: 552 - protein, 366 aa, Arabidopsis thaliana
  G2147,HLH/MYC domain coordinates 163-220
MSNYGVKELTWENGQLTVHGLGDEVEPTTSNNPIWTQSLNGCETLESVVHQAALQQPSKFQLQSPNGPNHNYESKDGSCSRKRGYPQEMDRWFAVQEESHRVGHSVTASASGTNMSWASFESGRSLKTARTGDRDYFRSGSETQDTEGDEQETRGEAGRSNGRRGRAAAIHNESERRRRDRINQRMRTLQKLLPTASKADKVSILDDVIEHLKQLQAQVQFMSLRANLPQQMMIPQLPPPQSVLSIQHQQQQQQQQQQQQQQQQQFQMSLLATMARMGMGGGGNGYGGLVPPPPPPPMMVPPMGNRDCTNGSSATLSDPYSAFFAQTMNMDLYNKMAAAIYRQQSDQTTKVNIGMPSSSSNHEKRD

SEQ ID NO: 553 - DNA, 929 bp, Arabidopsis thaliana
  G2148,family:HLH/MYC
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 554 - protein, 223 aa, Arabidopsis thaliana
  G2148,HLH/MYC domain coordinates 135-192
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 555 - DNA, 1466 bp, Arabidopsis thaliana
  G2150,family:HLH/MYC
gttttgtttttgaagaaacacacataaagtttgtctttttacttctcaaatttggttgttttcactcaatttcaatcttgctttctgattcagattctgggttttcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctcaaccttaaacaaaaaaaaaacaagaaaacttcagatta

SEQ ID NO: 556 - protein, 371 aa, Arabidopsis thaliana
  G2150,HLH/MYC domain coordinates 194-252
MNMDKETEQTLNYLPLGQSDPFGNGNEGTIGDFLGRYCNNPQEISPLTLQSFSLNSQISENFPISGGIRFPPYPGQFGSDREFGSQPTTQESNKSSLLDPDSVSDRVHTTKSNSRKRKSIPSGNGKESPASSSLTASNSKVSGENGGSKGGKRSKQDVAGSSKNGVEKCDSKGDNKDDAKPPEAPKDYIHVRARRGQATDSHSLAERARREKISERMTLLQDLVPGCNRITGKAVMLDEIINYVQSLQRQVEFLSMKLATVNPRMEFNANASLSTEMIQPGESLTQSLYAMACSEQRLPSAYYSLGKNMPRFSDTQFPSNDGFVHTETPGFWENNDLQSIVQMGFGDILQQQSNNNNNNCSEPTLQMKLEP

SEQ ID NO: 557 - DNA, 1666 bp, Arabidopsis thaliana
  G2154,family:AT-hook
gcaaaaagaaaaaatgaaaaaaaatccctaactctctctctctagaaattcttatttttgtgcgtatctctctaaaaaggaatggatcctaacgaaagccaccatcaccaccaacaacaacagctccatcacctccaccaacagcaacagcaacagcagcagcagcaacgactcacttctccttacttccaccaccaactacagcaccatcaccaccttccaaccaccgtagcaaccaccgcttctaccggaaacgccgttccatcttccaacaatgggcttttccctccgcagcctcagccacagcaccagcctaatgatgggtcatcttctctcgcggtgtaccctcattcagttccgtcctcggctgtgacggcgccgatggagccggtaaagaggaagaggggtcgaccaagaaagtatgtgacgccggaacaagccctagcggctaagaaattggcgtcttctgcgagtagttcgtctgctaaacagaggcgagagcttgctgctgttaccggtggtacggtatcgactaattccgggtcatccaagaaatctcagcttggttctgtcgggaaaactggacaatgttttactccgcatattgttaatatagctcctggcgaggatgtggtccagaaaattatgatgttcgcaaaccaaagcaagcatgaactatgcgttctttctgcatcaggcactatctctaatgcatccttgcgccaaccggctccatcaggaggcaacttaccatatgagggtcaatacgagattctctcactatctggatcctatatccgaactgaacaaggtggtaaatccggcggccttagcgtttctttatctgcttcagatggtcagatcatcggtggagcgattggtagccatctcacagctgctggcccggttcaggtgattcttggtacgtttcagcttgatagaaagaaggatgccgccgggagtggtgggaaaggggatgcttcaaacagtggaagtcggttaacttctcctgtaagctctggacagttgcttggcatgggtttccctcctggtatggaatctacgggaagaaatccaatgaggggaaacgacgagcaacatgatcatcatcatcatcaagccggtttgggtggacctcatcatttcatgatgcaagcgccgcaggggatacacatgacacattccaggccatctgaatggcgcggaggaggcaacagcggtcatgatggcagaggcggtggcgggtatgatttgtcaggaaggataggacatgagtcgtcggagaatggagattacgagcagcaaataccggattagcagagcttccaggagaagtgtgtagagtttagatcccaagtagagaaacagaaggcgagcaaagaatctgaactgagagaggacttattagacagagactcgtctgaagggtctttaatcatagaaagaagttgctgagtgattgcttttgttcttcttcttggtacggtgtattatattaactccacaaccttttttttatactttcagtaacgattctccttcactttcaatttcattccttttttttatactctttttcttttcttataatattttttttggtttttctttcgtttgttactaaaaaaggaaatgctctttttgtgaaatatatacacttcgtttg

SEQ ID NO: 558 - protein, 411 aa, Arabidopsis thaliana
  G2154,AT-hook domain coordinates 105-113,171-283
MDPNESHHHHQQQQLHHLHQQQQQQQQQQRLTSPYFHHQLQHHHHLPTTVATTASTGNAVPSSNNGLFPPQPQPQHQPNDGSSSLAVYPHSVPSSAVTAPMEPVKRKRGRPRKYVTPEQALAAKKLASSASSSSAKQRRELAAVTGGTVSTNSGSSKKSQLGSVGKTGQCFTPHIVNIAPGEDVVQKIMMFANQSKHELCVLSASGTISNASLRQPAPSGGNLPYEGQYEILSLSGSYIRTEQGGKSGGLSVSLSASDGQIIGGAIGSHLTAAGPVQVILGTFQLDRKKDAAGSGGKGDASNSGSRLTSPVSSGQLLGMGFPPGMESTGRNPMRGNDEQHDHHHHQAGLGGPHHFMMQAPQGIHMTHSRPSEWRGGGNSGHDGRGGGGYDLSGRIGHESSENGDYEQQIPD

SEQ ID NO: 559 - DNA, 1361 bp, Arabidopsis thaliana
  G2156,family:AT-hook
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 560 - protein, 302 aa, Arabidopsis thaliana
  G2156,AT-hook domain coordinates 72-80,81-232
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 561 - DNA, 1496 bp, Arabidopsis thaliana
  G2157,family:AT-hook
tcttttgattttaaccttttttcagtagcaagccaaaaaaaaaaaacagacaaagaagttccttttatgataaaggtatgatgatagcaaacaaatgatacccccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaattgattgtagaatcgtcttttgaattttgatgttggaaaaaaccaa

SEQ ID NO: 562 - protein, 310 aa, Arabidopsis thaliana
  G2157,AT-hook domain coordinates 88-96,97-240
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 563 - DNA, 1104 bp, Arabidopsis thaliana
  G216,family:MYB-(R1)R2R3
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 564 - protein, 367 aa, Arabidopsis thaliana
  G216,MYB-(R1)R2R3 domain coordinates 49-151
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 565 - DNA, 2807 bp, Arabidopsis thaliana
  G217,family:MYB-related
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 566 - protein, 844 aa, Arabidopsis thaliana
  G217,MYB-related domain coordinates 8-55
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 567 - DNA, 1385 bp, Arabidopsis thaliana
  G219,family:MYB-related
aaaagaagcagaatcattcccatttataacaaacctaaacctctcttttcttcttctctttacctttttcattccaaaatctctctctctctctctctttctctggctcgggaagaagatgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcgtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttgatgaagaagataatgttttaattaatttatattgtataagataagatctggatgatgattaatttgaaatttgagaattaggctaattagatactttgatcagaatcaagtgagtttttaagtttgaattagtgtgtacatgtttttttgctctttttgggggaaacgacttgtcgtttttgttgttgtatgatgtaaaacaacaggtagtctctgtgttgttttggtcaagacttgatcagattcagaagtgaagacgacttcaagcttaagatagtttagatgtgtcttttgaaaagtttaaacagaatggttattgggttaaggttaagtgtatctcatatgctttttctatcttttttttggtaagacttttccagtaatttgccgttttcttcggggtgtgtgttgttgataatgtcacattcatgaaccaaacacagttatataactttagtaaaaaaaaaaaaaaaaaaaaaaaa

SEQ ID NO: 568 - protein, 261 aa, Arabidopsis thaliana
  G219,MYB-related domain coordinates 98-146
MSRSCSQCGNNGHNSRTCPTDITTTGDNNDKGGGEKAIMLFGVRVTEASSSCFRKSVSMNNLSQFDQTPDPNPTDDGGYASDDVVHASGRNRERKRGTPWTEEEHRLFLTGLHKVGKGDWRGISRNFVKTRTPTQVASHAQKYFLRRTNQNRRRRRSSLFDITPDSFIGSSKEENQLQTPLELIRPVPIPIPIPPSRKMADLNLNKKKTPATTEMFPLSLNLQRPSSSTSSSSNEQKARGSRASSGFEAMSSNGDSIMGVA

SEQ ID NO: 569 - DNA, 913 bp, Arabidopsis thaliana
  G22,family:AP2
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 570 - protein, 226 aa, Arabidopsis thaliana
  G22,AP2 domain coordinates 88-152
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 571 - DNA, 771 bp, Arabidopsis thaliana
  G2213,family:bZIP-NIN
atgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattga

SEQ ID NO: 572 - protein, 256 aa, Arabidopsis thaliana
  G2213,bZIP-NIN domain coordinates 156-205
MSSSKHSSVFNYSALFLSLFLQQMDQNSLHHLDSPKIENEYEPDSLYDMLDKLPPLDSLLDMEDLKPNAGLHFQFHYNSFEDFFENIEVDNTIPSDIHLLTQEPYFSSDSSSSSPLAIQNDGLISNVKVEKVTVKKKRNLKKKRQDKLEMSEIKQFFDRPIMKAAKELNVGLTVLKKRCRELGIYRWPHRKLKSLNSLIKNLKNVGMEEEVKNLEEHRFLIEQEPDAELSDGTKKLRQACFKANYKRRKSLGDDYY

SEQ ID NO: 573 - DNA, 897 bp, Arabidopsis thaliana
  G2215,family:bZIP-NIN
atggctgatcacacaaccaaagaacagaagtcattctcattcctagctcattctccatcctttgatcacagctccttaagttatcctttattcgactgggaagaagatcttcttgctctccaagaaaactctggctctcaagcatttccttttactacaacttctctgcctttacctgatcttgaacccttgtctgaagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtga

SEQ ID NO: 574 - protein, 298 aa, Arabidopsis thaliana
  G2215,bZIP-NIN domain coordinates 150-246
MADHTTKEQKSFSFLAHSPSFDHSSLSYPLFDWEEDLLALQENSGSQAFPFTTTSLPLPDLEPLSEDVLNSYSSASWNETEQNRGDGASSEKKRENGTVKETTKKRKINERHREHSVRIISDITTYTTSSAPTTLSKETVSRYFYMPITQAAIALNVGLTLLKRRCRELGIRRWPHRKLMSLNTLISNVKELQKMEGEENAEKLQDALEMLEKEKRTIEDLPDLEFKDKTKRLRQACFKANHKRKKKRSLKSDQSQVPSCSSSGSVPSDESVDEAGMESDEEMKYLLCGFSSEFTSGL

SEQ ID NO: 575 - DNA, 1364 bp, Arabidopsis thaliana
  G222,family:MYB-(R1)R2R3
ctcattttataataattttctccatcttcttccttcctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatcttcagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacacggtgtttgatcagagcctttagattattaacatgtgttatagagagtttcattttctattcatattcatagacctgagtttattgattgatccatacatttgttatgcttgtgtgtaaagtatgtatatggtttttgatttatgtaaattttctgctcgagtgaatttttttggtgctaagatgtagttctttattccaaaaaaaaaaaa

SEQ ID NO: 576 - protein, 352 aa, Arabidopsis thaliana
  G222,MYB-(R1)R2R3 domain coordinates 13-119
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIFSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNTVFDQSL

SEQ ID NO: 577 - DNA, 1230 bp, Arabidopsis thaliana
  G2223,family:RING/C3H2C3
agaatcacacaagcttcacaatgtcatcatcatcatcaacgacgacgaacacaacaacagaatcagattcatcatctctacctactcacatcggtagatcaaattccgacggaatcatcgacactacaccatttcttcctcccaccgttacaagaaccataagcgtagatgaagaatccaatccaattcatcgatccgctagacgacaaggtctaagagaagcagcgaggttcctccgtcacgctggtagccggagaatgatgcgtgaaccatcgatgctcgttagagaaaccgctgctgagcaattagaagagagacaaagtgattgggcgtattctaaacctgtggtgtttcttgacattttgtggaatcttgcttttgttgccatcggtgttgctgttctgatacttagccgtgacgagaagcctaatatgccgttgagagtttgggttgttggttatgggattcaatgttggttacatatggcttgtgtttgtgttgagtataggcggaggagacgacgacgtcacccggaggatggtggtggttctgggttgacgaattcttcgtcgcagcaatatgtttcgttagcgcaattggaggatagaggagagactagtaatcctgcgaagcatcttgaatcagccaatacgatgttctcattcatctggtggataattggattctactgggtttctgcaggaggccaaacactatctagtgactctcctcagctctattggctgtgtatcatttttctcggtttcgatgttttctttgttgtgttctgtgttgcattggcttgtgttatcggccttgctgtttgctgttgtcttccatgtataattgcaattctatatgctgttgccgaccaggagggagcatcgaagaacgacatagatcaaatgccgaaattcagatttacaaaaactggcaatgttgaaaagctctcaggcaaagcacggggaataatgacggaatgtggaacagattcacctattgaacgctcgctctctccagaagacgcggaatgctgcatctgtctctgtgaatatgaagatggagttgaacttagagaactcccttgtaaccatcactttcattgcacttgcatcgataaatggcttcatataaactcacgttgcccgctctgcaagtttaacatcttgaagaacgcaaacaacgaagtctagtaaaatctgttctggttctaggatcaatccgaacgaa

SEQ ID NO: 578 - protein, 390 aa, Arabidopsis thaliana
  G2223,RING/C3H2C3 domain coordinates 338-378
MSSSSSTTTNTTTESDSSSLPTHIGRSNSDGIIDTTPFLPPTVTRTISVDEESNPIHRSARRQGLREAARFLRHAGSRRMMREPSMLVRETAAEQLEERQSDWAYSKPVVFLDILWNLAFVAIGVAVLILSRDEKPNMPLRVWVVGYGIQCWLHMACVCVEYRRRRRRRHPEDGGGSGLTNSSSQQYVSLAQLEDRGETSNPAKHLESANTMFSFIWWIIGFYWVSAGGQTLSSDSPQLYWLCIIFLGFDVFFVVFCVALACVIGLAVCCCLPCIIAILYAVADQEGASKNDIDQMPKFRFTKTGNVEKLSGKARGIMTECGTDSPIERSLSPEDAECCICLCEYEDGVELRELPCNHHFHCTCIDKWLHINSRCPLCKFNILKNANNEV

SEQ ID NO: 579 - DNA, 548 bp, Arabidopsis thaliana
  G2226,family:RING/C3H2C3
agacaacatcatttctaccgacaaagatttgatatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgct

SEQ ID NO: 580 - protein, 162 aa, Arabidopsis thaliana
  G2226,RING/C3H2C3 domain coordinates 103-144
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 581 - DNA, 1193 bp, Arabidopsis thaliana
  G2237,family:RING/C3H2C3
tctgctcaactctctgttctacttctgaatcgtcgttttccttcatataaccaaaccaattctgttgaatcatcttggcacattcattgttttgagaaggaacagaaaaagttctgatcttgtccctattcgcacatcaatggacgataatagatctactcatagctcaatgttcggtgacctatcaacagaagaggtcacaagtaagatcattctcacagcaatcattgttctattcatggcggttctgttcgtccttatcctccatctatacgccaaactctactggtggagaatagatcagctccaacagcaacagcaacaacaacagcaagagcaagagcaagaagaagaccaatcatccattgctccacctgtagtcactcgccgtcagcgacgtcgtttcatcttcgtcccaggccaagacgctctaagcaacactggactaacctcttttgaacttagttccttaccaattgtgtttttcagacaagatagttgcaaagatggtttggaatgctctatttgtttgtctgagcttgttaaaggagataaagctaggctgcttccaaagtgtaaccatagcttccatgttgagtgtattgacatgtggtttcagtctcactctacttgtccgatttgtagaaacactgttcttggtcctgagcaagctagctcaaagagagttgaacaagttccagacaatgcagaaaatgctggtaccaccaataacaaccatgatgctttgtctcaactttcaacttcttctccagaatttcccaccaatgtcttggtatggggtcgtcaggatcaagttagtaccggaaacaccaatgttgggactcaagaagacggtgctgctggtaatggtgcttctcagagtcaagaagctgttgttctggatatcagcgattcttccagtagaaatcataatgtatcatcttcgtcgtcatctatgaggtttattgttgaggaggaagaagcaaaatctccaatgacaacgaggttgaggtccttaaggaggtttctgagcagagacaagagagtgggttgtagcaatagtagtactagtaatagtagcagctccaatgctgttgcttctgttgatccttgaagattgtaattagcttagctgagtgagattgcctgaagatgtcaaactgtgtgtatgtggtctcggctctttattggct

SEQ ID NO: 582 - protein, 324 aa, Arabidopsis thaliana
  G2237,RING/C3H2C3 domain coordinates 127-168
MDDNRSTHSSMFGDLSTEEVTSKIILTAIIVLFMAVLFVLILHLYAKLYWWRIDQLQQQQQQQQQEQEQEEDQSSIAPPVVTRRQRRRFIFVPGQDALSNTGLTSFELSSLPIVFFRQDSCKDGLECSICLSELVKGDKARLLPKCNHSFHVECIDMWFQSHSTCPICRNTVLGPEQASSKRVEQVPDNAENAGTTNNNHDALSQLSTSSPEFPTNVLVWGRQDQVSTGNTNVGTQEDGAAGNGASQSQEAVVLDISDSSSRNHNVSSSSSSMRFIVEEEEAKSPMTTRLRSLRRFLSRDKRVGCSNSSTSNSSSSNAVASVDP

SEQ ID NO: 583 - DNA, 808 bp, Arabidopsis thaliana
  G2238,family:RING/C3H2C3
acaatgggaaacctgtttgacagtagcaagactttatggggaaacatgaaccatggatcgtcacgttactctctaaacggcaaaatcatgcttgcttccgtcatcatcctcttcgtcgccgtcattttaatcctctgtttccacagctacgctagatggttattccgccgtcaaaaccgccgtattcgccgccgtatcagtgctcacctccgatcactcgccgccgctagagaccccacccaatcatcatcctccctctctcctcttgatccgacggtgctcgagaagatccctatcttcgtctactccgttaaaacccatgaatctccgcttgaggaatgctctgtttgcttgtcggaattcgaagaagacgacgaaggacgtgtccttcccaaatgcggccacgtgttccatgtcgattgtatagacacgtggttccggtccagatcaagttgtcctctttgtagagctccggttcaacccgcacagccggttaccgaacccgaaccggttgctgctgtgtttccatcggttaaaccaattgaggataccgaagccggaagttcctcttcatcggacgaatccgaatcctcgacgccgtcttcctcctctggttcgccggtgaggtttccgatggaagcttgtgagagagaaccgattgatttagtcggtatcattgtggagattcccagggaatttcaagattctaattcggatctacccgcagataacgggtcgaatcgtcgggcttcgttgaaaaggctatggattatttgatcacataattggatagtgactgaatccgacc

SEQ ID NO: 584 - protein, 257 aa, Arabidopsis thaliana
  G2238,RING/C3H2C3 domain coordinates 113-154
MGNLFDSSKTLWGNMNHGSSRYSLNGKIMLASVIILFVAVILILCFHSYARWLFRRQNRRIRRRISAHLRSLAAARDPTQSSSSLSPLDPTVLEKIPIFVYSVKTHESPLEECSVCLSEFEEDDEGRVLPKCGHVFHVDCIDTWFRSRSSCPLCRAPVQPAQPVTEPEPVAAVFPSVKPIEDTEAGSSSSSDESESSTPSSSSGSPVRFPMEACEREPIDLVGIIVEIPREFQDSNSDLPADNGSNRRASLKRLWII

SEQ ID NO: 585 - DNA, 1228 bp, Arabidopsis thaliana
  G2239,family:RING/C3H2C3
aactcaaaatcatgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttagttgacttttcttttctcatc

SEQ ID NO: 586 - protein, 398 aa, Arabidopsis thaliana
  G2239,RING/C3H2C3 domain coordinates 128-169
MRSSDHMAFAGVLPIVFLLILSSADLAASQSQPGPTNQPYNYGRLSPAMAVIVVILIAALFFMGFFSIYFRHCSGVPDAGVSPAGGARSRATVNAAARGLDVSVVETFPTFLYSDVKTQKLGKGELECAICLNEFEDDETLRLLPKCDHVFHPHCIDAWLEAHVTCPVCRANLAEQVAEGESVEPGGTEPDLELQQVVVNPEPVVTAPVPEQLVTSEVDSRRLPGVPVDLKRVKFSRSHTTGHSVVQPGECTERFTLRLPEDVRKRIMKDWKLNRTNSLLVLPRGGSSRRGKPIDRSRARSDRWLFRKTPSFLWRSRDDGSIRLGATGSVRASAVPNSTGSDSVRAGDRWAFLRNASFLWRNSSVHVPRGGVNKDGEGTSVKSTGASGSTSGSVRLPV

SEQ ID NO: 587 - DNA, 584 bp, Arabidopsis thaliana
  G225,family:MYB-related
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 588 - protein, 94 aa, Arabidopsis thaliana
  G225,MYB-related domain coordinates 36-80
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 589 - DNA, 682 bp, Arabidopsis thaliana
  G2251,family:RING/C3H2C3
ctcacccattctccaccttatcatcacaatccaaaactctctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtccaaacaaaaaaaaaagacatattaaatcctttttttttggtactttcattgggaattgggtttgg

SEQ ID NO: 590 - protein, 166 aa, Arabidopsis thaliana
  G2251,RING/C3H2C3 domain coordinates 89-132
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 591 - DNA, 1042 bp, Arabidopsis thaliana
  G2252,family:RING/C3H2C3
aacccgacgattaattgcacgatgtccgatgctccgtcgtcttccccggatgccacggcgtcgcactggtgctatcactgcaacaaacgcgtcgtcgttgaaaccttagatgactttgtcgtgtgctgcgaatgtaacaaaggtttcgtcgagtcaattcaaccgactcccgccgcttattcatcgccggcgccaccgcagccactttccccagatctgaatgtagaagactccagtattggctcgcatttcctccagatgctccgcttgttagcccacgcgccttctcagcgttcaccaccacgacaccttgatgttttatcttacgaagatgatttcttcaggttggagctcaatagtagaaacgaaatcgacgatgacgaagacgaagatgaagatgatggagatgaagaagaagaggatgaggaagagaatttaaccgtcaacgacgaagaagacgaagaagatgatctgaggaggagaaatcgttttcctctcacgacgacgcagtcgagaaccggaagaaacagaattctcgattgggctgagattttgatgggaatcgaagacaattcgattgagttccgtatggaatcagatcgatacgcaggaaatccggctgattacatagacgatgcagccggatacgaagctttgctacagaatttagcagaaggagatggtggtggtggcggaggaaggagaggcgcaccaccggctgcgaaatcggcaatagaggcattggagactttcgaggttagttcttcggagggagagatggttatggtttgtgctgtgtgtaaagatggaatggtgatgggagaaactggtaagaagttaccgtgtggacattgttaccacggagattgtattgtgccatggttaggaacaaggaactcttgtcctgtctgtagattccagcttgagactgatgatgctgaatatgaggaagagaggaaaaaaagaacttctaccgtgtcagattctgctgctgcttcttcttcttcttcaacttctcgttactgaagtggaggaaatgccc

SEQ ID NO: 592 - protein, 334 aa, Arabidopsis thaliana
  G2252,RING/C3H2C3 domain coordinates 257-297
MSDAPSSSPDATASHWCYHCNKRVVVETLDDFVVCCECNKGFVESIQPTPAAYSSPAPPQPLSPDLNVEDSSIGSHFLQMLRLLAHAPSQRSPPRHLDVLSYEDDFFRLELNSRNEIDDDEDEDEDDGDEEEEDEEENLTVNDEEDEEDDLRRRNRFPLTTTQSRTGRNRILDWAEILMGIEDNSIEFRMESDRYAGNPADYIDDAAGYEALLQNLAEGDGGGGGGRRGAPPAAKSAIEALETFEVSSSEGEMVMVCAVCKDGMVMGETGKKLPCGHCYHGDCIVPWLGTRNSCPVCRFQLETDDAEYEEERKKRTSTVSDSAAASSSSSTSRY

SEQ ID NO: 593 - DNA, 680 bp, Arabidopsis thaliana
  G2269,family:RING/C3H2C3
ccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 594 - protein, 212 aa, Arabidopsis thaliana
  G2269,RING/C3H2C3 domain coordinates 136-177
MSTATLVVFPPPPPVPIPTYITSLGLGYSIAIALGFLVLISTIILSSYICCRASRLRFSASAANANANASFSDRGVIVPRIIFVAEDDDLESGNVVVGGLDHSVINSYPKFHFTKDITAVVNGDGFHDGEGRETTCSICLCEYMEEEMLRMMPECKHYFHVYCLDAWLKLNGSCPVCRNSPLPTPQSTPQSTPLSEVVPLSQYAADRRRSRR

SEQ ID NO: 595 - DNA, 989 bp, Arabidopsis thaliana
  G227,family:MYB-(R1)R2R3
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 596 - protein, 320 aa, Arabidopsis thaliana
  G227,MYB-(R1)R2R3 domain coordinates 13-113
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 597 - DNA, 1209 bp, Arabidopsis thaliana
  G229,family:MYB-(R1)R2R3
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 598 - protein, 371 aa, Arabidopsis thaliana
  G229,MYB-(R1)R2R3 domain coordinates 14-120
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 599 - DNA, 1312 bp, Arabidopsis thaliana
  G2290,family:WRKY
ttctttctttctttctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgctaactcattatatatagaagatattgcagaccagaatatgcgcagggagggtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattct

SEQ ID NO: 600 - protein, 287 aa, Arabidopsis thaliana
  G2290,WRKY domain coordinates 147-205
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 601 - DNA, 827 bp, Arabidopsis thaliana
  G2291,family:AP2
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 602 - protein, 256 aa, Arabidopsis thaliana
  G2291,AP2 domain coordinates 113-180
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 603 - DNA, 1178 bp, Arabidopsis thaliana
  G2293,family:WRKY
atacacaacccctcttcttctccaccttctctccattttctctttctctcatatctctctgtctacttctactcctctttctccatctgcaactcatatatttccaaaaagtgatcaagatcaacaaaatatccgaatcttgatccgacctttctttcttagcttaacttcttgtaaatatatataactatagtctatactctatagagcatatatataaacatgaagcgaggtctagatatggcgagaagctacaatgatcatgaaagtagtcaagaaaccggacccgaatcaccaaattcttcaacctttaacggcatgaaagctcttatctcttctcattcgcctaaaagaagcaggagatccgtagagaagagagtagtgaacgtaccgatgaaagaaatggaaggatctcggcacaaaggggacacaactccgccctcagattcatgggcttggcgtaagtacggccaaaagcccattaagggatctccataccctagaggttattaccgttgtagtagcacaaaaggttgtccggcgaggaagcaagtcgagagaagcagagatgatccaacgatgattctcatcacttacacttctgagcataaccatccttggcctctcacttcttccacaagaaacgggcctaaacctaaacccgagcccaaacccgaacctgagcctgaggtagagccagaggcggaggaggaggataataagtttatggttcttggaagggggattgaaacgacgccatcatgtgtcgacgagttcgcatggtttacggagatggagacaacatcttcgacgattcttgagagcccgattttctcgtcggagaaaaagacggctgtctcgggggctgatgacgtggcggtgttctttccgatgggagaagaggatgagtctttgttcgccgatctcggcgagttgccggagtgttctgtggtgtttcgtcaccggagtagcgtagtggggtcacaagttgagatcttttgacacgtggtgatattttattggatattattgtcgctcacatgggaagcgttgtacgcacggcgtttttgttttagtttctcaacggtaatcaataaatcatcatataagactctttatacttgttattgataaaaaaaaggtatgattcgattttgtaattccttttaaaaacaaaa

SEQ ID NO: 604 - protein, 259 aa, Arabidopsis thaliana
  G2293,WRKY domain coordinates 74-134
MKRGLDMARSYNDHESSQETGPESPNSSTFNGMKALISSHSPKRSRRSVEKRVVNVPMKEMEGSRHKGDTTPPSDSWAWRKYGQKPIKGSPYPRGYYRCSSTKGCPARKQVERSRDDPTMILITYTSEHNHPWPLTSSTRNGPKPKPEPKPEPEPEVEPEAEEEDNKFMVLGRGIETTPSCVDEFAWFTEMETTSSTILESPIFSSEKKTAVSGADDVAVFFPMGEEDESLFADLGELPECSVVFRHRSSVVGSQVEIF

SEQ ID NO: 605 - DNA, 962 bp, Arabidopsis thaliana
  G2295,family:MADS
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 606 - protein, 294 aa, Arabidopsis thaliana
  G2295,MADS domain coordinates 1-57
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 607 - DNA, 860 bp, Arabidopsis thaliana
  G2296,family:WRKY
atcctaaacagaaaatatgtctcttgagattgatgcgaaggctgtctcagcactcctccttggccaaggatgcgctaacaatctcaagacgctcctcaaaaaccatgaaacaggctcagtttcaacagagccactcatcaactccattcttgattctttctcgtttgctctgtcttctcagaacataccacgtcatgtgtctcaaagatcatcaaagaaaaagatgtgtggaatacaaggtatggaagattctccgacaccggcccacattgatggcttcatctggaggaaatatggacaaaagaccatcaaaacctctccgcaccaaaggtggtactaccgatgtgcctatgcgaaagaccaaaactgcgacgctaccaagcgggtacagaagatccaagacaatcctccagtgtacagaaacacctatgtcggacaacatgcatgtgaagctccagcttatgcagttaataatggtggtacatacggttcaaaaatgatcaaattcgactatgttattcctgaatcggttatgcctcaacctttatcaattgattcccaagaaattaccatggaggataaagacacagacgaccatattttgaactatattaacgagcatttgatggaagatgaggcgtatgatgttttccctgatgtacttggagaacgttgctgctttggattagaaccctttccaggattgaacattaataaatcttaaaagcttttcatgttcttcgatcttatggtggagaatgaatgattcattcttcatttcttttcatgttcatgttttgtaattttgatttacgtgttgtttttttgtaaaaggaagttttatcagtgatgtatttctt

SEQ ID NO: 608 - protein, 235 aa, Arabidopsis thaliana
  G2296,WRKY domain coordinates 85-145
MSLEIDAKAVSALLLGQGCANNLKTLLKNHETGSVSTEPLINSILDSFSFALSSQNIPRHVSQRSSKKKMCGIQGMEDSPTPAHIDGFIWRKYGQKTIKTSPHQRWYYRCAYAKDQNCDATKRVQKIQDNPPVYRNTYVGQHACEAPAYAVNNGGTYGSKMIKFDYVIPESVMPQPLSIDSQEITMEDKDTDDHILNYINEHLMEDEAYDVFPDVLGERCCFGLEPFPGLNINKS

SEQ ID NO: 609 - DNA, 1067 bp, Arabidopsis thaliana
  G2299,family:AP2
gccaaaattttaccaacatttttctcttctcatatcaaagtttctctctcatttcttcatcacacttcactgccctgttttttttcctcattttgaatagttctcaaacttatatatttttccccctgaagcctagctatttctttttatttgcattaatctcgggatccgaatcgaaaaaagcaatcagaataatagacttgtacgatacttgtgcctaagctaacacaatggcagaggaatactacagcctccgctcggagagagtaactcagcttcttgtccctaactcggagtctgactcagtgagtgacaaaagcaaagctgagcaaagcgagaagaagactaaacgtgggagagactccggtaaacaccctgtttatcgcggagtaaggatgaggaactggggaaaatgggtgtcggagattcgtgagccgaggaagaaatcacgtatttggctgggaactttcccgacgccggagatggcggcgcgtgcacacgacgtggcggctctgagcattaaaggaacggccgctatactaaacttccctgaactcgctgactcattccctcgacccgtttcattaagccctcgagacattcagacagcagctcttaaagcagctcacatggaaccgacgacgtcgttttcatcttccacgtcttcgtcgtcgtctttgtcttctacgtcttcgctcgagtctcttgtgttggtgatggacctctcgaggactgagtcggaggagctcggtgagattgtggagcttccaagtctcggggcgagttacgacgtcgactcggctaaccttgggaacgagtttgtcttctatgactcagttgactactgtttatatccgccgccgtggggacagtcgtccgaagataactatggtcacggaattagccctaattttggccatggcttgtcatgggatctctaacagtttattttgtatcattaccataatgttttgtttaaaacagtttattttgtatcattgccataatgttttgtttaatcacgtttttaaaaccctttgctgtttttgttttttttttgagttttt

SEQ ID NO: 610 - protein, 236 aa, Arabidopsis thaliana
  G2299,AP2 domain coordinates 48-115
MAEEYYSLRSERVTQLLVPNSESDSVSDKSKAEQSEKKTKRGRDSGKHPVYRGVRMRNWGKWVSEIREPRKKSRIWLGTFPTPEMAARAHDVAALSIKGTAAILNFPELADSFPRPVSLSPRDIQTAALKAAHMEPTTSFSSSTSSSSSLSSTSSLESLVLVMDLSRTESEELGEIVELPSLGASYDVDSANLGNEFVFYDSVDYCLYPPPWGQSSEDNYGHGISPNFGHGLSWDL

SEQ ID NO: 611 - DNA, 2688 bp, Arabidopsis thaliana
  G2304,family:AKR
atggccttcgggaggggacgtggcaacaaacgcacttcgacgtcgtcctatgcgtcgaccattacaatggtcatctttgtggctctgtgtgtcttcggggtgtggatgctttcttccaattccgttattccaccgcagatcacacaaggctccactcgagcggctgtcgcagagacagagaggagtgatgtgtctgcctcttcaaacggtaatgatgagcccgaacccacgaaacaagagtctgatgagcaacaggcatttgaagacaatccgggaaagcttccagacgatgccgtaaagtctgaagacgagcaacggaagtcagcgaaagagaagagtgaaacgacgagctcaaagactcaaacacaagagacccaacaaaacaacgatgacaaaatttccgaggaaaaagagaaagataacggcaaggagaaccagacggtgcaagagagtgaggagggtcagatgaaaaaagtcgtcaaggagtttgaaaaggaacagaaacaacagcgggacgaggacgctgggactcagcccaaagggactcaagggcaagagcagggacaagggaaggaacagccggatgtggaacaaggaaataaacaagggcaagaacaggattcgaatacggatgtgacattcacagatgcgaccaaacaagaacaacctatggaaacggggcagggggaaacatcagagacctcaaagaatgaagaaaacggacaaccagaggaacaaaactcagggaatgaggaaaccggacaacaaaacgaggagaagacaacagctagtgaagaaaacgggaagggagagaagagcatgaaagatgagaatggccaacaggaagaacataccacagcagaggaagaaagcggaaacaaagaagaagagagcacatcaaaggacgaaaacatggagcaacaagaagagcggaaggatgagaaaaaacacgaacagggttcagaagccagtggttttggctctggaataccgaaagaatctgcagaatcacagaagtcatggaagagtcaggcaacagaatctaaggacgagaaacaaagacagacatctgaatcaaacaccgtagagaggattatggatggaaatgcatgggtgctgtgcaatgcaactgcaggaactgactatataccatgcctagacaacgaagaagctataatgaaactaaggagtagaagacattttgagcacagagagagacattgcccagaagacccaccaacgtgtctcgtccccctcccagaaggttataaggaggccatcaagtggcctgaaagcagagataagatatggtaccacaatgtcccacacacaaagctagctgaggtaaaaggacatcagaactgggtgaaggtcactggcgagttcttgacgtttcctggtggtggaacacagttcatccatggagctcttcattatatcgattttcttcagcagtctttgaaaaacattgcgtggggtaaacgtactcgggtcatattggatgttggatgtggagtggcgagctttggcggtttcctctttgaaagagatgttatagcaatgtctcttgcaccaaaagatgaacacgaggctcaagtccagtttgctcttgaaagaaagattccagccatctcagcagttatgggctctaagcgactgccattcccgagcagagtgtttgatcttatccactgtgcacgttgtagagtcccatggcataatgagggtggtatgcttcttctggaacttaatcggatgcttaggcctggaggttattttgtctggtcagcaacaccagtctaccagaagcttgaagaagatgttcaaatctggaaagaaatgtccgcgttgacaaaatccttgtgctgggaacttgtgacaatcaacaaggataaactcaatggtattggtgctgcaatctaccagaaacctgccaccaatgaatgttacgagaaaagaaagcacaacaagcctccactgtgcaaaaacaacgacgatgcaaatgcagcctggtatgtacccctacaagcatgtatgcataaagttcctaccaatgtggtcgagagaggaagcaagtggcccgtgaattggccccgtcggcttcaaacaccgccttactggttaaacagctctcaaatggggatatatgggaaaccagctcctcgagatttcactacagattatgaacactggaaacatgttgtaagcaaagtatacatgaatgaaataggaatcagctggtcaaatgtgaggaatgtaatggacatgcgagctgtctacggagggtttgcagcagctctgaaggacctacaggtgtgggtaatgaatgtagtaaacataaattcaccagatacactaccgataatctacgagagaggcctattcggaatatatcatgactggtgtgaatcatttagcacataccctcgaagctatgatctcttacatgcagatcatcttttctcaaagttgagaacaaggtgcaatcttgttccagtaatggcagaagtggatagaatagtaagaccaggaggtaaactaatagttcgtgacgaatcaaatgtgataagagaagttgagaacatgttgaagtcactgcactgggatgttcacttaactttctccaaacaccaagaaggaatcttaagtgcacaaaaaggattctggagaccagaaacttctcaatga

SEQ ID NO: 612 - protein, 895 aa, Arabidopsis thaliana
  G2304,AKR domain coordinates 381-886
MAFGRGRGNKRTSTSSYASTITMVIFVALCVFGVWMLSSNSVIPPQITQGSTRAAVAETERSDVSASSNGNDEPEPTKQESDEQQAFEDNPGKLPDDAVKSEDEQRKSAKEKSETTSSKTQTQETQQNNDDKISEEKEKDNGKENQTVQESEEGQMKKVVKEFEKEQKQQRDEDAGTQPKGTQGQEQGQGKEQPDVEQGNKQGQEQDSNTDVTFTDATKQEQPMETGQGETSETSKNEENGQPEEQNSGNEETGQQNEEKTTASEENGKGEKSMKDENGQQEEHTTAEEESGNKEEESTSKDENMEQQEERKDEKKHEQGSEASGFGSGIPKESAESQKSWKSQATESKDEKQRQTSESNTVERIMDGNAWVLCNATAGTDYIPCLDNEEAIMKLRSRRHFEHRERHCPEDPPTCLVPLPEGYKEAIKWPESRDKIWYHNVPHTKLAEVKGHQNWVKVTGEFLTFPGGGTQFIHGALHYIDFLQQSLKNIAWGKRTRVILDVGCGVASFGGFLFERDVIAMSLAPKDEHEAQVQFALERKIPAISAVMGSKRLPFPSRVFDLIHCARCRVPWHNEGGMLLLELNRMLRPGGYFVWSATPVYQKLEEDVQIWKEMSALTKSLCWELVTINKDKLNGIGAAIYQKPATNECYEKRKHNKPPLCKNNDDANAAWYVPLQACMHKVPTNVVERGSKWPVNWPRRLQTPPYWLNSSQMGIYGKPAPRDFTTDYEHWKHVVSKVYMNEIGISWSNVRNVMDMRAVYGGFAAALKDLQVWVMNVVNINSPDTLPIIYERGLFGIYHDWCESFSTYPRSYDLLHADHLFSKLRTRCNLVPVMAEVDRIVRPGGKLIVRDESNVIREVENMLKSLHWDVHLTFSKHQEGILSAQKGFWRPETSQ

SEQ ID NO: 613 - DNA, 755 bp, Arabidopsis thaliana
  G2313,family:MYB-related
cgtcgacacaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaagc

SEQ ID NO: 614 - protein, 206 aa, Arabidopsis thaliana
  G2313,MYB-related domain coordinates 111-159
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 615 - DNA, 483 bp, Arabidopsis thaliana
  G2315,family:PMR
atggacgtaacgttacctcatcatgtggtagaagatattcttgaacgacttcctgtaaaaacactccgtaaattcaaatgcgtttgtagcacatggagatccactatagactcacaacgtttcaaggatagacatatgattcatggacaactactcgaagatcccgatatcctccttctcgggcgttgggatcctcccagtctatccaaaaacgcttctctaatgacattgacgtttgactcatcgaccatgccgttttctttcaagattcaaactatacccggaaaagccaacttttacaaagtcactcaaagtcactcaaagtcactcaaagttgtgacggtctatgattcgaacatggaggctactggtttagtgctatatgatatgactcaatcagaaagaacatttgctaacttttgtttatcattcaaaaacagagagacacccactgcttatttcccaagcttaatcactatttaa

SEQ ID NO: 616 - protein, 160 aa, Arabidopsis thaliana
  G2315,PMR domain coordinates 4-60
MDVTLPHHVVEDILERLPVKTLRKFKCVCSTWRSTIDSQRFKDRHMIHGQLLEDPDILLLGRWDPPSLSKNASLMTLTFDSSTMPFSFKIQTIPGKANFYKVTQSHSKSLKVVTVYDSNMEATGLVLYDMTQSERTFANFCLSFKNRETPTAYFPSLITI

SEQ ID NO: 617 - DNA, 1389 bp, Arabidopsis thaliana
  G2316,family:PMR
atggagagtagagaggattcattcatatcaaaagagaagaaatcaactatgaaaaaagaaaaacaagcgattgcatcacaaagaaatagaagaagagtaattaaaaatagaggaaacgggaagcgattgattgcatcattatcacaacgaaagagaagaagaatacctagaggaagaggaaacgagaaggcagtgtttgcaccatcatcactaccaaacgatgttgtagaggaaatcttcttacgacttccggtgaaagcaataatccaactaaagtctctctcaaaacaatggagatcgacgatcgagtctcgcagttttgaagagagacacttgaagatcgtcgagcgatcacgcgtggattttccacaggtcatggtcatgtctgaagaatattccttgaaaggaagtaaaggtaatcagcctcgtccagatacagacattggttttagtacaatctgtttggaatcggcttctattctgtcctccactcttatcactttccctcaaggatttcaacaccggatctatgcttctgaaagctgtgacggacttttctgcatccattccctaaaaacacaagccatatatgtagttaacccggccactcggtggtttcgacaacttcctccggctaggtttcagattttgatgcaaaagttataccccactcaagacacttggattgacataaaaccagtagtctgttatacagcattcgtgaaggccaatgattacaaattagtgtggttgtataattctgatgcctcgaatccaaacctgggagttacaaagtgcgaggtttttgattttagggcaaacgcttggaggtacttgacttgcactccaagctatcggatattccctgaccaagtaccagcagctacaaacgggtctatttattggttcacggaaccatataatggcgaaataaaagtggtagctctcgatattcacactgaaacgtttcgtgtgctacctaagattaatccggccattgctagttcagatcctgaccatatcgacatgtgcactttggataatggtttgtgcatgtcgaaaagagaatcggatacgttggtccaagagatatggaggttaaaatcatcagaagactcatgggagaaggtttataccatagatttgctttcttgttcttcttcttctttatctgagttccgcgatggatttaattggacacgaaaagatttggttgagccatccacaccagtggcgatatgcaaggacaagaagattctgctctcacatcgctatgcccgcaatatgatcaaatacgatccccaaataaaatctatcagtttaatttaccaacctcctttgtgtagaagatatgcttcttattttcagagtttgatctctcatatataa

SEQ ID NO: 618 - protein, 462 aa, Arabidopsis thaliana
  G2316,PMR domain coordinates 96-282
MESREDSFISKEKKSTMKKEKQAIASQRNRRRVIKNRGNGKRLIASLSQRKRRRIPRGRGNEKAVFAPSSLPNDVVEEIFLRLPVKAIIQLKSLSKQWRSTIESRSFEERHLKIVERSRVDFPQVMVMSEEYSLKGSKGNQPRPDTDIGFSTICLESASILSSTLITFPQGFQHRIYASESCDGLFCIHSLKTQAIYVVNPATRWFRQLPPARFQILMQKLYPTQDTWIDIKPVVCYTAFVKANDYKLVWLYNSDASNPNLGVTKCEVFDFRANAWRYLTCTPSYRIFPDQVPAATNGSIYWFTEPYNGEIKVVALDIHTETFRVLPKINPAIASSDPDHIDMCTLDNGLCMSKRESDTLVQEIWRLKSSEDSWEKVYTIDLLSCSSSSLSEFRDGFNWTRKDLVEPSTPVAICKDKKILLSHRYARNMIKYDPQIKSISLIYQPPLCRRYASYFQSLISHI

SEQ ID NO: 619 - DNA, 945 bp, Arabidopsis thaliana
  G2318,family:MYB-related
atggagagtgtggtggcaacatggagcagagaagaagagaaagcattcgagaacgcaattgcgttgcattgtgtagaggaagagataacagaggatcaatggaacaaaatgtcgtcaatggtaccaagcaaagccttagaagaagtaaagaaacattaccaaatccttttagaagatgtcaaagcaatcgagaatggtcaagttcctttacctcgttatcatcaccgcaaaggtctcatcgtagatgaagcagcagcagcagctacttctcctgccaacagagactctcattcctctggatcatctgagaagaaaccaaatcctggcacctccgggataagtagctccaatggaggaagaagtggtggctcgagagctgagcaagagagaagaaaagggattccatggactgaagaagagcatcggttgtttcttttgggtttggacaagtttgggaaaggagattggagaagcatttcaaggaactttgtgatctcaagaactccaacacaagttgcaagtcatgctcaaaaatacttcatcaggcttaactcgatgaaccgagatagaaggcggtctagcattcacgacatcaccactgtgaacaatcaagctcctgcggttacaggaggaggacaacaaccgcaagtggttaaacatagaccagctcagccacaaccacagccacaaccgcaaccacaacaacatcatcccccaacaatggctggattagggatgtatggtggtgcgccagtgggacaaccgatcatcgcaccacctgatcatatgggttcagctgttggaacacctgtgatgcttccacctccaatgggaactcatcatcatcaccatcaccatcatcttggagttgctccttatgctgtaccggcttatccggtaccgccattaccgcagcaacatccagctccgtcgacaatgcactga

SEQ ID NO: 620 - protein, 314 aa, Arabidopsis thaliana
  G2318,MYB-related domain coordinates 134-182
MESVVATWSREEEKAFENAIALHCVEEEITEDQWNKMSSMVPSKALEEVKKHYQILLEDVKAIENGQVPLPRYHHRKGLIVDEAAAAATSPANRDSHSSGSSEKKPNPGTSGISSSNGGRSGGSRAEQERRKGIPWTEEEHRLFLLGLDKFGKGDWRSISRNFVISRTPTQVASHAQKYFIRLNSMNRDRRRSSIHDITTVNNQAPAVTGGGQQPQVVKHRPAQPQPQPQPQPQQHHPPTMAGLGMYGGAPVGQPIIAPPDHMGSAVGTPVMLPPPMGTHHHHHHHHLGVAPYAVPAYPVPPLPQQHPAPSTMH

SEQ ID NO: 621 - DNA, 1256 bp, Arabidopsis thaliana
  G232,family:MYB-(R1)R2R3
aaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagcaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacaacaacatagtgaatcttgagaccatcgagaacacaaaagtctatggagacgcctcagtagccggagccgctgtccgagcagctttggccggagggacaacgagtacatcggcggatcaaagtacaataagttgggaggatataacttctctagttaattccgaagatgcaagttacttcaatgcgccaaatcatgtgtaacattttgtttaaaactttatttgtacttacatacataaagaggggttttctattttgtaaaaaaaaaaaaaa

SEQ ID NO: 622 - protein, 376 aa, Arabidopsis thaliana
  G232,MYB-(R1)R2R3 domain coordinates 14-115
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNNNIVNLETIENTKVYGDASVAGAAVRAALAGGTTSTSADQSTISWEDITSLVNSEDASYFNAPNHV

SEQ ID NO: 623 - DNA, 1412 bp, Arabidopsis thaliana
  G2334,family:GRF-like
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcaagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 624 - protein, 380 aa, Arabidopsis thaliana
  G2334,GRF-like domain coordinates 82-194
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQVFH

SEQ ID NO: 625 - DNA, 2084 bp, Arabidopsis thaliana
  G2342,family:MYB-(R1)R2R3
aaagtttttttcgaataaagttttggtttttttaacgttcccttcttcttcctcctcctcgcgaattcgcttatctgtcgatcacgatgagcttaagttcgaatccaccggtttgttcaccggaaaaggaggaaagaagtgaaatgaaaattgagattcaatgtatggagaataagcaaccattagctgcttcttgctcttctgcatccgaaggcagtggctgtttcttcctcaagtcacctgagatcgcaactcctgccacagtatcttcatttcctcggaggactagtggacctatgagacgagcaaaaggtggttggactccagaggaggatgagacacttagacgagcagttgaaaagtataaggggaagaggtggaagaaaatagcggaatttttcccagagagaacagaggtccaatgcttgcacaggtggcagaaagttcttaatccagagcttgttaaaggaccttggactcaagaggaggatgataaaatcgttgaacttgtaaaaaaatatggacctgccaaatggtctgtcatcgccaagtccttaccaggtcgtattgggaaacaatgtcgagaaaggtggcacaaccatttaaatcctggtattagaaaggatgcttggaccgtagaagaagaatcagctctcatgaattctcatcgaatgtacggaaacaaatgggcggaaattgctaaggttttaccaggaaggactgataacgccataaagaaccattggaatagttcactgaagaaaaaattagagttctacttagcaactggtaacttgccaccgccagcaagcaaattcatcgttctgaaagatattgctgatggagacagagattccaagcagtctagtgcaactaaacctttcaaggattctgattcgcttacccaaacctcttcaggaaatacagattcaaatgaagttggaagagaccattttgactcttcttccgctctgcttgaagaagtagctgcttcacgaagaatcggtgtcaatgagtatgcttgctctcctgttgagtacaagcctcagttgcctaatctggaaccaatttcagaggaagtcagaatcaactcaaaagcttattttgagagatcaatccagaggaaagtagaaaacgggtttggaactccaaagcatgggaatttatactataagtctccacttgactattactttccatcagaagcggatctgcaacatatgtacggatatgaatgtggttgcagtcccggtgctgcatcaccagtcagcttaatgactacaccctgtaataaagacagtggtttaactgcaacgagaagtcctgaatctttcttgagagaagctgctaggacttttccaaacacaccttctatttttaggaaaaggcgaaaggttgttttggcagcgaaaacagatgctgttgttgttgttaatggtgtagttaaggaagttgatcgaaaagaagaaagtaaagatatgagaaaaagtttgttgctggagacaactgataattgcagtgatgatgaagaactcgggttaaatggaaatgctttcaatttgtctccaccatatcggttaagagctaaaagaacagctgtaatcaaatcaagacagcttgagtttacatctgaaaaggagaagcagccagataatgagattgagtttacatctgcaaaagagaagcagcctgataatgaaattaaaacgtctgaggaagacaagcctgtgtagaacccttcttcccttagaaaactgtgagtgaaaatttcaaatcttttatttaatgtcactaatctgagtaacaaatctaaaataattccatccttgttgacacagagatcgtgtgaagaaaccagtatggttccagaagaattgaagctttgctgggaagagaaccgtgaagaaaaacaattctcattctcttcctcacagccttgagctatgaatctacggctttggtctaacacccgaactaaaatgaaataggtaggtaggtacactcacaagtagtttaatttcatcgttcacatacatggtgtcctgtttgtttagcaaaaaaaaaaaaaaaaaaaaaaaaaaaaa

SEQ ID NO: 626 - protein, 548 aa, Arabidopsis thaliana
  G2342,MYB-(R1)R2R3 domain coordinates 75-179
MSLSSNPPVCSPEKEERSEMKIEIQCMENKQPLAASCSSASEGSGCFFLKSPEIATPATVSSFPRRTSGPMRRAKGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRKDAWTVEEESALMNSHRMYGNKWAEIAKVLPGRTDNAIKNHWNSSLKKKLEFYLATGNLPPPASKFIVLKDIADGDRDSKQSSATKPFKDSDSLTQTSSGNTDSNEVGRDHFDSSSALLEEVAASRRIGVNEYACSPVEYKPQLPNLEPISEEVRINSKAYFERSIQRKVENGFGTPKHGNLYYKSPLDYYFPSEADLQHMYGYECGCSPGAASPVSLMTTPCNKDSGLTATRSPESFLREAARTFPNTPSIFRKRRKVVLAAKTDAVVVVNGVVKEVDRKEESKDMRKSLLLETTDNCSDDEELGLNGNAFNLSPPYRLRAKRTAVIKSRQLEFTSEKEKQPDNEIEFTSAKEKQPDNEIKTSEEDKPV

SEQ ID NO: 627 - DNA, 1113 bp, Arabidopsis thaliana
  G2343,family:MYB-(R1)R2R3
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 628 - protein, 370 aa, Arabidopsis thaliana
  G2343,MYB-(R1)R2R3 domain coordinates 14-116
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 629 - DNA, 573 bp, Arabidopsis thaliana
  G2344,family:CAAT
atgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttga

SEQ ID NO: 630 - protein, 190 aa, Arabidopsis thaliana
  G2344,CAAT domain coordinates 100-159
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 631 - DNA, 1341 bp, Arabidopsis thaliana
  G236,family:MYB-(R1)R2R3
atgaagaagaagaagaagattcttcttcattccgatgattccaagaagaaggagcgtcatattgttacttggtctcctgaggaggatgatatactaaggaagcaaatcagtttacagggaactgaaaattgggcgatcattgcatccaagtttaatgataagagcacaaggcagtgtagaagaagatggtatacatacttgaactctgatttcaagagaggaggttggtcccctgaagaagatacacttttgtgtgaggcacagagattgtttgggaataggtggactgagatagcaaaagtggtctcaggaagaacggataatgctgtgaagaacaggtttactacactgtgcaagaagagggctaagcatgaagctatggcgaaagagaacaggattgcttgttgtgttaactcagacaacaagagactgttgttcccagatggtattagtacaccgctaaaagccgaaagtgaatctcctcttactaagaaaatgaggagaagtcatattccaaatcttacagagattaagagctatggggatagatcacatataaaggttgaatcgactatgaatcaacagagaagacatccattttctgtagtagcccacaatgccacaagtagtgatggtacagaggagcagaaacaaataggcaatgtgaaagagagtgacggtgaggataaaagtaaccaagaggtgtttcttaagaaggatgattcaaaggtgacagctttgatgcaacaagctgaacttctcagttcattggcccagaaagttaatgcagacaacacagaccaaagcatggagaatgcctggaaggttctacaggatttcttgaataagagcaaagaaaatgatctatttagatatggaatcccagatattgatttccaactcgatgaatttaaagatcttgttgaggacttgaggagtagtaatgaagatagtcaatcatcttggaggcaacctgatctccatgattcaccagcaagctctgaatatagctcaggatcaggatcaggatcaaccataatgacgcatccttctggtgataaaacccaacaacttatgtctgatactcagacaacatcacatcagcaaaatggtggggagttactacaagataatgggattgtgtctgatgcaactgtggaacaagtgggtttactctcaactggtcatgatgtgttaaagaactctaatgagactgtgcctatcccgggtgaagaagagtttaactcgcctgttcaagtcactccattgttcagatctctagcagcaggcatcccaagcccacaattctctgaaagtgtaagtatccacctaacaaattga

SEQ ID NO: 632 - protein, 446 aa, Arabidopsis thaliana
  G236,MYB-(R1)R2R3 domain coordinates NA
MKKKKKILLHSDDSKKKERHIVTWSPEEDDILRKQISLQGTENWAIIASKFNDKSTRQCRRRWYTYLNSDFKRGGWSPEEDTLLCEAQRLFGNRWTEIAKVVSGRTDNAVKNRFTTLCKKRAKHEAMAKENRIACCVNSDNKRLLFPDGISTPLKAESESPLTKKMRRSHIPNLTEIKSYGDRSHIKVESTMNQQRRHPFSVVAHNATSSDGTEEQKQIGNVKESDGEDKSNQEVFLKKDDSKVTALMQQAELLSSLAQKVNADNTDQSMENAWKVLQDFLNKSKENDLFRYGIPDIDFQLDEFKDLVEDLRSSNEDSQSSWRQPDLHDSPASSEYSSGSGSGSTIMTHPSGDKTQQLMSDTQTTSHQQNGGELLQDNGIVSDATVEQVGLLSTGHDVLKNSNETVPIPGEEEFNSPVQVTPLFRSLAAGIPSPQFSESVSIHLTN

SEQ ID NO: 633 - DNA, 920 bp, Arabidopsis thaliana
  G237,family:MYB-(R1)R2R3
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 634 - protein, 283 aa, Arabidopsis thaliana
  G237,MYB-(R1)R2R3 domain coordinates 11-113
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 635 - DNA, 1077 bp, Arabidopsis thaliana
  G2371,family:ABI3/VP-1
ccaaaccaacacctgcaaatcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaaaaatggacaagaattaatattattagtagcttcgttatgtatttagtatttaactaatttgaaaataaaaataaaagatgagattttgtttctaaaaaaaaaaaaaaaaaaaaaaaaaaa

SEQ ID NO: 636 - protein, 267 aa, Arabidopsis thaliana
  G2371,ABI3/VP-1 domain coordinates 25-127
MSVNHYHNTLSLHHHHQNDVAIAQRESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQRHRFDLHRLFIGWRRRGEASSSPAVSVVSQEALVNTTAYWSGLTTPYRQVHASTTYPNIHQEYSHYGAVVDHAQSIPPVVAGSSRTVRLFGVNLECHGDAVEPPPRPDVYNDQHIYYYSTPHPMNISFAGEALEQVGDGRG

SEQ ID NO: 637 - DNA, 1263 bp, Arabidopsis thaliana
  G2373,family:TH
gcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgg

SEQ ID NO: 638 - protein, 383 aa, Arabidopsis thaliana
  G2373,TH domain coordinates 290-350
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 639 - DNA, 1414 bp, Arabidopsis thaliana
  G2376,family:TH
cacgagcttctgactcagatccggcgatatcgaattccatggaggacgatgaagacatccgatctcagggttccgattcacctgatccgtcttcctccccgccggcgggacgaatcacggttacggtggcttcggcaggtccgccttcttattctctgactcctccgggtaattcgtcgcagaaggatccggatgcgttggctctggcgctgcttccgattcaggccagcggtggagggaataacagcagtgggagaccaaccggcggcggcgggagggaggattgttggagcgaagcagctacggctgtgttgattgatgcgtggggtgagagatacttggagcttagcagagggaatctgaagcagaagcactggaaagaggtggctgagattgtgagcagcagagaggattacggtaaaattcccaaaactgatatacagtgtaagaataggatcgatacggtgaagaagaagtataaacaagagaaggtgagaatcgctaacggcggtggccgtagcagatgggtgttcttcgacaagcttgaccgtctgattggatcaacggcgaagatcccgacggcaacttctggagtcagcggtcctgtcggaggattgcataagattcctatgggtattccaatgggaagtcgttcgaatctgtaccatcagcaagctaaggctgcaacaccgcctttcaataatcttgaccggttaattggagctacggctagagtctcagctgcttctttcggtggcagtggtggaggaggcggaggaggatctgtcaatgtacctatgggaattccgatgagtagccgttcagctccgtttggacagcaagggaggactctgccacagcaaggtaggacactgccacagcaacagcagcaagggatgatggtgaaaaggtgtagtgagtcgaaacgctggcgtttcaggaagaggaacgcttctgattcagactcggaatctgaagcagcaatgtcagatgattccggtgacagtttaccacctcctcctctgtcgaagaggatgaagacggaggagaagaagaagcaagatggtgatggagtggggaacaaatggagggagctgactcgggcaatcatgagattcggtgaagcttatgagcaaacagagaatgcgaaactgcaacaggtggttgagatggagaaagagaggatgaagttcttgaaggagcttgagttgcagagaatgcagttctttgtgaagactcaattggagatatcacaacttaagcagcaacatgggaggagaatgggaaacaccagtaatgatcatcatcacagccgcaagaacaacatcaatgcgattgtcaacaacaacaacgatttgggtaataactagaatttagtgatgcagtgtcgtaattgatatattttagatttgag

SEQ ID NO: 640 - protein, 443 aa, Arabidopsis thaliana
  G2376,TH domain coordinates 79-178,336-408
MEDDEDIRSQGSDSPDPSSSPPAGRITVTVASAGPPSYSLTPPGNSSQKDPDALALALLPIQASGGGNNSSGRPTGGGGREDCWSEAATAVLIDAWGERYLELSRGNLKQKHWKEVAEIVSSREDYGKIPKTDIQCKNRIDTVKKKYKQEKVRIANGGGRSRWVFFDKLDRLIGSTAKIPTATSGVSGPVGGLHKIPMGIPMGSRSNLYHQQAKAATPPFNNLDRLIGATARVSAASFGGSGGGGGGGSVNVPMGIPMSSRSAPFGQQGRTLPQQGRTLPQQQQQGMMVKRCSESKRWRFRKRNASDSDSESEAAMSDDSGDSLPPPPLSKRMKTEEKKKQDGDGVGNKWRELTRAIMRFGEAYEQTENAKLQQVVEMEKERMKFLKELELQRMQFFVKTQLEISQLKQQHGRRMGNTSNDHHHSRKNNINAIVNNNNDLGNN

SEQ ID NO: 641 - DNA, 1105 bp, Arabidopsis thaliana
  G2377,family:TH
cagaaattcttatcctaagcctctttctccaccgcgcacgttagcctcctctctttcccactccgagatggagacgacgccggagactcagtcgaagactcaccgtctaccggcgggaagagaggattggtggagcgaagacgctacggcgacattgatcgaagcttggggagatcgttacgtcaatctcaaccggggaaatctccggcaaaacgattggaaagaagtcgccgacgccgtcaattcaagccacgggaatggccggccaaagaccgatgtacagtgcaaaaaccggatcgatacgttgaagaagaagtacaaaactgaaaaggcgaaacctttatcgaattggtgcttctttgatagactcgatttcttaatcggtccggttatgaagaaatcgtccggtgctgttgttaaatcggcgttgatgaaccctaatttgaatcctactggatctaaatcaactggtagctctctcgatgacgatgatgatgatgatgatgacgacgaagaagatgatgatgatgcgggtgattggggatttgtggtgaggaagcatcgtaaagttgaagatgtagattcgagtgaaggatcagcctttagggagctagcgagatcgattctgaagttaggggaagcgtttgagagaatcgaggggaagaagcaacagatgatgattgaattggagaaacagagaatggaagttgcaaaggagcttgagttacaacgaatgaatatgttgatggagatgcaattggagcttgagaaatctaaacttgggaaacgaagagctgcttcaggtaagaagttgtaggattgtagattgtggaggagttactgatgtgaagcaaggagcaatggttggatctaaagctcatacgatttggagaagatgttattattattgatctttaggttttcttaagttatagcgcgatgctttttttcttcttcttctttttcattctcttttttagcattgtagagttacattggtagtagcaatgcgaattaccaaaagaactctcatagtatctgacatatcaagatgtacttttgtgaagtatcaatgtatgatggtttgtgtaaaaaaaaaaaaaaa

SEQ ID NO: 642 - protein, 249 aa, Arabidopsis thaliana
  G2377,TH domain coordinates 17-110,153-237
METTPETQSKTHRLPAGREDWWSEDATATLIEAWGDRYVNLNRGNLRQNDWKEVADAVNSSHGNGRPKTDVQCKNRIDTLKKKYKTEKAKPLSNWCFFDRLDFLIGPVMKKSSGAVVKSALMNPNLNPTGSKSTGSSLDDDDDDDDDDEEDDDDAGDWGFVVRKHRKVEDVDSSEGSAFRELARSILKLGEAFERIEGKKQQMMIELEKQRMEVAKELELQRMNMLMEMQLELEKSKLGKRRAASGKKL

SEQ ID NO: 643 - DNA, 1347 bp, Arabidopsis thaliana
  G239,family:MYB-(R1)R2R3
atggaagattacgagcgaataaactcaaactctccaacacatgaagaagattctgatgtacggaaaggtccatggaccgaggaagaagatgcaatcctagtcaacttcgtctctattcatggcgatgctcgttggaaccacatcgctcgttcctctgggctaaagcgaactggtaagagttgtagattaagatggcttaattacttacgtccagatgttagaagaggcaacatcactctcgaagaacaatttatgatcctcaaactccattctctttggggcaataggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaaggaaatatacgattactatacgtaacgaggaattcaattgcgtcacgtttggtgtaatattcattcgtgcgtgatgccaattttagatacggccttggtatacgaatctttgacttaattattatcttttcttttcctctcttgttttaaacccctgattaaattaagatttgatcatcagacgaggatatttgtgattcactgatttgtgatattgatatatgtgaattatttgatataacgttttaaaaaccaacaaaaaaaaaaaatcattccaaggaaaagttcttaattttgatactcgaaaagagcgtagactgactcgaatcagttcatattttctttggttcgttttatttacgacaaaattcactaacaaaaattaaaaaacgacaaaacgaaaatatgactaaatttatttttttgtcagttaaccactgattataggttgaaattgtcacaacacatgatttatcttgatagaaatttagtagtccagaatgctgcatggttgatcctaagaaa

SEQ ID NO: 644 - protein, 273 aa, Arabidopsis thaliana
  G239,MYB-(R1)R2R3 domain coordinates 21-125
MEDYERINSNSPTHEEDSDVRKGPWTEEEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSLPTTCEQVESMITDPSQPVNEPSPVEPGFVQFSQNHHQQFVPATELSATSSNSPAETFSDVRGGVVNGSGYDPSGQTGFGEFNDWGCVGGDNMWTDEESFWFLQDQFCPDTTSYSYN

SEQ ID NO: 645 - DNA, 1370 bp, Arabidopsis thaliana
  G2394,family:RING/C3H2C3
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatcc

SEQ ID NO: 646 - protein, 407 aa, Arabidopsis thaliana
  G2394,RING/C3H2C3 domain coordinates 355-395
MDVSSIVRNTTLTDQDPLLMDHGNREHIVDITSNDEEDSSSRSSLDELTPQGNSHQGEETVLSSSNATQQHPTHPSPPQQRPTSSRRGDNGNGRRTRSPLNSGLWISVELVVTVAQIVAAIVVMVLAKDEHPEAPLFTWVIGYTCGCLATLPILYWRFRTYNRATGQDSSQRATSSQGNSESTPYTAVSVAQAADEENSTGVSAAPRNNQVGESLRTRLNGLVDHFKMAIDCFFAVWFVVGNVWIFGGHSSPSDSPKLYRLCIAFLTFSCIGYAMPFILCATICCCLPCLISVLGFRENFSQTRGATAEAINALPVYRFKSKSRNDLEFSEEGEGGFLLLGSQKKRLISGEDASCCICLTRYGDDEQVRELPCSHVFHVDCVDKWLKINATCPLCKNEVGESSSASS

SEQ ID NO: 647 - DNA, 615 bp, Arabidopsis thaliana
  G2400,family:RING/C3H2C3
atggctggtatgcttcccggagttgagtgtgcaaggaggcggcgcttccacggtggtgctcctccgattgaatcctcgaacacagcttctgtggcggctgcggcgggacacgtctggacacggcgaccatcgttctctctttacactaccaatcatgagagccaccaggcccatgtctccttctcggagagaagtgttaggaataaatcttatggagaagacaacgatgagaaacttgacggagcagccaaagaggcaaagcagaggcttaacaagcggctgagaatcccaccacgtacaaggttcgatttagtaaaaaacggcgtgcaaaatggtaaagacaaagggaataaattggagcaaggaaagggtaaacctctcggggacttaccgaccgaggtggtcgggttaaagaagagccgaggaaggttgatggaatggttcaagcggcgagttagggaacaacaagattgtgctatatgtctagaccggttcaagaagggtgagaccttggtacacctaccatgtgcccataagtttcactccatatgcttattgccttggctagacaccaatgtttattgcccatattgtagaactgatatttggaattaa

SEQ ID NO: 648 - protein, 204 aa, Arabidopsis thaliana
  G2400,RING/C3H2C3 domain coordinates 158-198
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRFDLVKNGVQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 649 - DNA, 1046 bp, Arabidopsis thaliana
  G241,family:MYB-(R1)R2R3
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 650 - protein, 273 aa, Arabidopsis thaliana
  G241,MYB-(R1)R2R3 domain coordinates 14-114
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 651 - DNA, 1409 bp, Arabidopsis thaliana
  G2417,family:GARP
cataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggc

SEQ ID NO: 652 - protein, 397 aa, Arabidopsis thaliana
  G2417,GARP domain coordinates 235-285
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 653 - DNA, 1195 bp, Arabidopsis thaliana
  G242,family:MYB-(R1)R2R3
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 654 - protein, 305 aa, Arabidopsis thaliana
  G242,MYB-(R1)R2R3 domain coordinates 6-106
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 655 - DNA, 762 bp, Arabidopsis thaliana
  G2421,family:MYB-(R1)R2R3
atggagggttcgtccaaagggttgaggaaaggtgcatggactgctgaagaagatagtctcttgaggcagtgtattggtaagtatggagaaggcaaatggcatcaagttcctttaagagctgggctaaatcggtgcaggaaaagttgtagactaagatggttaaactatttgaagccaagtatcaagagaggaaaatttagttctgatgaagttgatcttcttcttcgtcttcataagcttctaggaaataggtggtccttgattgctggtcgattacctggtcggaccgctaatgatgtcaagaactactggaacacccatctgagtaagaagcatgaaccgtgttgtaaaactaagataaaaaggataaatattataacccctcctaatacaccggcccaaaaagtttgtgaaaatagtatcacatgtaacaaagatgatgagaaagatgattttgtggataattttatggttggagataatatatggttggagcgtttgctagacgagggccaagaggtagatgtgctggttacagaagcggcggcaacagaaaaggagggcactttggcgtttgacgttgagcaactttggaatttgttcgatggagagactgtgatctttgattagtgtttataaacgtttgtgttctcttgtttgtgaggtttctctatttaatttagtatctattttctaaattaactaatatcttatagtattttaggcaaaccttatgtttccgtttctgtgcggccgctctag

SEQ ID NO: 656 - protein, 209 aa, Arabidopsis thaliana
  G2421,MYB-(R1)R2R3 domain coordinates 9-110
MEGSSKGLRKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSKKHEPCCKTKIKRINIITPPNTPAQKVCENSITCNKDDEKDDFVDNFMVGDNIWLERLLDEGQEVDVLVTEAAATEKEGTLAFDVEQLWNLFDGETVIFD

SEQ ID NO: 657 - DNA, 741 bp, Arabidopsis thaliana
  G2422,family:MYB-(R1)R2R3
atgggcgaatcacccaaagggttgagaaaaggtacatggactactgaagaagatattctcttgaggcaatgcattgataagtatggagaaggcaaatggcatcgagttcctttaagaactggtctcaatcggtgccgaaagagttgtagacttagatggttgaattatttgaagccaagtattaagagaggaaaactctgctccgatgaagttgatcttgttcttcgccttcataaacttctaggaaataggtggtccttgatcgctggtagattgcctggtcggactgctaatgatgtcaagaattactggaacactcatttgagtaagaagcacgatgaacgatgctgtaagacgaagatgataaacaaaaacattacttctcatcctacttcatcggcccaaaaaatcgatgttttaaagcctcggcctcgatccttctccgataaaaatagttgcaacgatgtcaatatcttgccaaaagttgacgttgttcctttacatcttggactcaacaacaattatgtttgtgaaagtagtattacatgtaacaaagatgagcaaaaagataagcttattaatattaatctattggatggagataatatgtggtgggaaagtttactggaggcagatgtgttgggtccagaagctacggaaacagcaaagggtgtgaccttaccgcttgactttgagcaaatttgggctcggtttgatgaagagactttagaactgaattag

SEQ ID NO: 658 - protein, 246 aa, Arabidopsis thaliana
  G2422,MYB-(R1)R2R3 domain coordinates 9-110
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSKKHDERCCKTKMINKNITSHPTSSAQKIDVLKPRPRSFSDKNSCNDVNILPKVDVVPLHLGLNNNYVCESSITCNKDEQKDKLININLLDGDNMWWESLLEADVLGPEATETAKGVTLPLDFEQIWARFDEETLELN

SEQ ID NO: 659 - DNA, 816 bp, Arabidopsis thaliana
  G2425,family:MYB-(R1)R2R3
atggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttga

SEQ ID NO: 660 - protein, 271 aa, Arabidopsis thaliana
  G2425,MYB-(R1)R2R3 domain coordinates 12-119
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDGVYVSDFYDETEHLDLFLL

SEQ ID NO: 661 - DNA, 1038 bp, Arabidopsis thaliana
  G2426,family:MYB-(R1)R2R3
atgggcagatcgccatgttgtgataaggccgggttgaagaaagggccttggactccagaagaggatcagaaacttttggcttatattgaagaacatggccatggaagctggcgttctttgcctgagaaagccggtctccaaaggtgtggaaagagttgcagactcagatggactaactacctaagacctgacatcaagagaggcaaattcactgtacaagaagaacaaaccatcattcaactccacgctctcctcggaaacaggtggtcagcgattgcaactcatttaccaaagaggacagacaacgagatcaagaactactggaacacacacttgaagaaacgtctgatcaaaatggggatagatccagtgactcacaagcacaaaaacgagactctttcgtcttccacaggacaatcaaagaacgcagccacgcttagtcatatggctcaatgggagagtgcaagactcgacgctgaagcaaggctagctagagaatcaaagcttctccatttacagcattaccaaaacaataacaaccttaacaaatcagcagctcctcaacaacattgcttcactcaaaaaacatcaacaaactggactaaaccaaaccaaggaaacggagaccaacagcttgaatctccgacatcgacggtgacattctctgagaatcttctgatgcctttaggaatccctacggatagcagcagaaatagaaacaataacaacaatgagtcctcggcgatgattgaattggccgtatcttcgtcaacctcctccgatgtgagtctggtcaaagaacatgaacacgactggattaggcagatcaactgtggtagtggaggaataggagaaggattcacgagtctattgatcggtgattcggtcggccggggtttacccaccgggaaaaacgaagcgacggcgggcgtggggaatgagagtgagtataactactatgaggataacaagaattactggaatagcattctcaacttggttgattcttcaccgtccgattccgcgacgatgttctga

SEQ ID NO: 662 - protein, 345 aa, Arabidopsis thaliana
  G2426,MYB-(R1)R2R3 domain coordinates 14-114
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKKRLIKMGIDPVTHKHKNETLSSSTGQSKNAATLSHMAQWESARLDAEARLARESKLLHLQHYQNNNNLNKSAAPQQHCFTQKTSTNWTKPNQGNGDQQLESPTSTVTFSENLLMPLGIPTDSSRNRNNNNNESSAMIELAVSSSTSSDVSLVKEHEHDWIRQINCGSGGIGEGFTSLLIGDSVGRGLPTGKNEATAGVGNESEYNYYEDNKNYWNSILNLVDSSPSDSATMF

SEQ ID NO: 663 - DNA, 1557 bp, Arabidopsis thaliana
  G2427,family:MYB-(R1)R2R3
atgattgcttttttagggtttctctgtttcttatcaaagtctggatcttttttttctttcattgagatgatggatcttcaggaagaaacaggtgaagtgaaaattgaggatcagtgtgtagaaaataagcaatcaacacctgcttcgtgctcttctgtatctgaaggcagtgctggtagttcccacaagtcacctacaattgcaagtcctgccacagtatcacctactcataggtacctcgggaggacgagtggccctataaggcgagccaaaggtgggtggactccggaagaggatgagacattgagacaagcagttgacacgtttaaaggcaagagctggaagaacatagcgaaatctttccctgatagaactgaagttcaatgcctgcatcggtggcagaaagttctaaatccagaccttattaagggaccttggacacatgaggaggatgagaaaatcgttgaactggttgaaaaatacgggcctgcgaaatggtctattatcgcacagtctttaccaggtcgaattgggaagcaatgccgagagaggtggcataaccatttgaatcctgatattaacaaggatgcttggaccacagaggaagaagtagctctcatgaatgctcatcgaagccacggaaacaaatgggctgaaattgctaaggtcttacccggcaggactgataatgcaataaagaaccattggaatagttcattgaaaaagaagtcagaattctacttattgactggtaggttaccaccaccaacaacaacaaggaatggtgttcctgatagtgtaaccaaacgttcatcgtctgctcagaaaagggtttttggttcagttgctcaaacctcatcagtaactacagatgtaaacaatctcgctgaagacggaaatggccaaataaactcatctgttcctgtcgaagaagtagtagctgcttcacgaatgactagtcttaatgagtatgctcgttctcctcagttgcctaacccagagccattgccagagaatggtggagctgcaaataatggttatcatctgtactacacgcctcaaatagactattacagggcgtcagaagtggatacgcagcgtatgtatgggaatgaatgtggttgcagtccaagcgcatcaccagttagcttcttcactccaccgccgtgtaggaatgtgcacagtaacggttcgactccaagaagtcctgaatcttacctgagagaagctggtagaacttacccaaacacaccatccatattcaggaaaagacgacccagggttgttgttcaggataacaacaacgccaagaaaacagatgaagctaaagaggttgatcaaaaggtgaatgatggtaaggatagttcagagattcaaaataatggatcaaatgcttacaatctatctcctccatatcggataagatcgaaaaggacagcagttttcaaatcaagacagcttgagtttatatctagagaggaagagaaagctgatgatgaaaccaaatcatctgagaaagatatgttgattgatggagattctcaactcctaggctaa

SEQ ID NO: 664 - protein, 518 aa, Arabidopsis thaliana
  G2427,MYB-(R1)R2R3 domain coordinates 90-244
MIAFLGFLCFLSKSGSFFSFIEMMDLQEETGEVKIEDQCVENKQSTPASCSSVSEGSAGSSHKSPTIASPATVSPTHRYLGRTSGPIRRAKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKSEFYLLTGRLPPPTTTRNGVPDSVTKRSSSAQKRVFGSVAQTSSVTTDVNNLAEDGNGQINSSVPVEEVVAASRMTSLNEYARSPQLPNPEPLPENGGAANNGYHLYYTPQIDYYRASEVDTQRMYGNECGCSPSASPVSFFTPPPCRNVHSNGSTPRSPESYLREAGRTYPNTPSIFRKRRPRVVVQDNNNAKKTDEAKEVDQKVNDGKDSSEIQNNGSNAYNLSPPYRIRSKRTAVFKSRQLEFISREEEKADDETKSSEKDMLIDGDSQLLG

SEQ ID NO: 665 - DNA, 1017 bp, Arabidopsis thaliana
  G243,family:MYB-(R1)R2R3
atgtcaaagagaccatattgtatcggagaaggactgaagaaaggagcatggactacagaagaggataaaaaactcatctcttatatccacgaccacggtgaaggaggctggcgtgacattccagaaaaagctgggctgaaacggtgtggaaagagttgtagattacggtggactaactatttgaaaccagatatcaagagaggagagtttagctatgaggaagagcagattatcatcatgcttcatgcatctcgtggcaataagtggtctgtcatagctagacatttgccaaaaagaacggataacgaggtcaaaaactattggaacacacatctcaagaaacgtttaatcgatgatggcattgatcccgtgacacacaagccactagcttcttctaaccctaatccagttgagcccatgaagttcgatttccaaaagaaatccaatcaggatgagcactcttcacagtctagttctacaactccagcatctcttcccctttcctcgaatttgaacagtgttaaatccaaaattagcagtggtgagacgcagatagaaagtggtcacgtgagctgcaagaaacgttttggacgatcgagctctacatcaaggttgttaaacaaagttgcagctagagcttcttccatcggcaacatcttatcaacatccatagaaggaaccttgagatctcccgcatcatcttcaggactcccagactcgttctctcaatcatatgagtacatgatcgataacaaagaagatctcggtacgagcattgatctcaacatccccgagtatgatttcccacagtttcttgagcaactcattaacgatgacgacgaaaatgagaacattgttgggcccgaacaagatctccttatgtccgatttcccatcaacattcgttgatgaagacgatatacttggagacataaccagttggtcaacttatcttcttgaccatcccaattttatgtatgaatcggatcaagattccgacgagaagaacttcttatga

SEQ ID NO: 666 - protein, 338 aa, Arabidopsis thaliana
  G243,MYB-(R1)R2R3 domain coordinates 12-128
MSKRPYCIGEGLKKGAWTTEEDKKLISYIHDHGEGGWRDIPEKAGLKRCGKSCRLRWTNYLKPDIKRGEFSYEEEQIIIMLHASRGNKWSVIARHLPKRTDNEVKNYWNTHLKKRLIDDGIDPVTHKPLASSNPNPVEPMKFDFQKKSNQDEHSSQSSSTTPASLPLSSNLNSVKSKISSGETQIESGHVSCKKRFGRSSSTSRLLNKVAARASSIGNILSTSIEGTLRSPASSSGLPDSFSQSYEYMIDNKEDLGTSIDLNIPEYDFPQFLEQLINDDDENENIVGPEQDLLMSDFPSTFVDEDDILGDITSWSTYLLDHPNFMYESDQDSDEKNFL

SEQ ID NO: 667 - DNA, 1109 bp, Arabidopsis thaliana
  G2437,family:GATA/Zn
gatccgttcaattgtcatcttcatcgtttccgtcgtgttatttggtgtttctcgtttgggtctttcgaacatctttcattcttctctttttggtgttgctccccacgaacaggtagattgatgaaaagcaaccatggatgacctacatggaagcaatgctcgaatgcacattagagaagctcaagatccaatgcatgtgcaatttgaacatcatgctttgcatcacatccacaatggaagcggtatggttgatgaccaggctgatgatggcaatgctggtgggatgagtgagggtgtggaaacagacattccttctcaccctggaaatgtaactgacaatcgtggtgaagtggtcgaccgtggtagtgaacaaggagatcagttaacattgtcttttcagggccaagtctacgtttttgacagtgtcttgcctgagaaggttcaagctgtgcttctattattgggtggtcgtgaattacctcaggcagcccctcctggcctaggatcacctcatcagaacaacagagtatcgagtttacctggtactcctcaaaggtttagtattccgcagcgattagcttctttggtcagatttcgagagaaacggaaaggaaggaattttgataagaagattcggtatacagtccgcaaggaggtagctttgaggatgcaacgcaataaaggtcagttcacatctgccaagtcaaacaatgatgaagctgcatctgctggatctagctgggggtcgaatcaaacctgggccatagaaagtagtgaggctcagcatcaagagatctcatgtcggcactgtggaattggcgagaagtcaactccaatgatgcgacgtggacctgccgggccaagaacactttgcaatgcatgtggacttatgtgggcaaacaagggtgcttttagggacttatccaaagcctctcctcaaacagcccagaatcttcctttaaataagaatgaagatgcaaatcttgagactgatcatcaaataatgataacagtggccaatgacataagcaactcacagtgaggacatgttggctcttgccattacaagcaagagaaagatcccaacagagtttgaatcgcctcagcgg

SEQ ID NO: 668 - protein, 302 aa, Arabidopsis thaliana
  G2437,GATA/Zn domain coordinates 223-250
MDDLHGSNARMHIREAQDPMHVQFEHHALHHIHNGSGMVDDQADDGNAGGMSEGVETDIPSHPGNVTDNRGEVVDRGSEQGDQLTLSFQGQVYVFDSVLPEKVQAVLLLLGGRELPQAAPPGLGSPHQNNRVSSLPGTPQRFSIPQRLASLVRFREKRKGRNFDKKIRYTVRKEVALRMQRNKGQFTSAKSNNDEAASAGSSWGSNQTWAIESSEAQHQEISCRHCGIGEKSTPMMRRGPAGPRTLCNACGLMWANKGAFRDLSKASPQTAQNLPLNKNEDANLETDHQIMITVANDISNSQ

SEQ ID NO: 669 - DNA, 1080 bp, Arabidopsis thaliana
  G245,family:MYB-(R1)R2R3
atgggaaaatcttcaagctcggaggaaagtgaagtgaagaaagggccatggactccggaggaagacgagaagctcgtaggctatattcaaacgcacggtcccggcaaatggcgtacccttcccaagaacgccgggttaaaaagatgcgggaagagttgtagattgcgatggacgaattatctaagacccgatatcaagagaggagagttctctcttcaagaggaagaaaccatcattcaacttcatcgtcttcttggaaacgaatggtccgcaattgctattcacttaccaggaagaacagataatgaaatcaaagactattggaacacacatattaaaaagaaactcttacgaatggggattgatccggtgactcattgtccccgcattaatcttctccagctctcttcgtttcttacctcatcattgtttaaatctatgtcacaaccgatgaatactccatttgatctcactacttcaaatattaatcctgatatcttgaatcatctcactgcctctctcaacaacgttcagaccgaatcataccaaccaaaccaacagcttcaaaacgacctaaacactgaccaaaccactttcaccggtttgctcaactcaacaccacccgttcaatggcaaaacaatggagaatacttgggagattatcacagttataccggtacaggtgatccatctaataacaaagtccctcaagccggaaactactcatcagccgcatttgtatccgaccacattaatgatggtgagaattttaaggccggatggaatttcagttcatcaatgctagcgggaacttcatcgagcagctcgacaccgttgaattcgtcttcgactttttatgtcaatggtggaagcgaagatgatagagagagttttggtagcgacatgttgatgtttcatcatcatcatgatcataataataatgctttgaatctatcataatgtcttatttattttgcttcttgatcttatttgttttatttttacttttttttaatgggggtttgtaattgtgttacatactttgtaatataagagcttagtctattattatgttgactc

SEQ ID NO: 670 - protein, 319 aa, Arabidopsis thaliana
  G245,MYB-(R1)R2R3 domain coordinates 14-114
MGKSSSSEESEVKKGPWTPEEDEKLVGYIQTHGPGKWRTLPKNAGLKRCGKSCRLRWTNYLRPDIKRGEFSLQEEETIIQLHRLLGNEWSAIAIHLPGRTDNEIKDYWNTHIKKKLLRMGIDPVTHCPRINLLQLSSFLTSSLFKSMSQPMNTPFDLTTSNINPDILNHLTASLNNVQTESYQPNQQLQNDLNTDQTTFTGLLNSTPPVQWQNNGEYLGDYHSYTGTGDPSNNKVPQAGNYSSAAFVSDHINDGENFKAGWNFSSSMLAGTSSSSSTPLNSSSTFYVNGGSEDDRESFGSDMLMFHHHHDHNNNALNLS

SEQ ID NO: 671 - DNA, 804 bp, Arabidopsis thaliana
  G2452,family:MYB-related
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 672 - protein, 267 aa, Arabidopsis thaliana
  G2452,MYB-related domain coordinates 28-79,146-194
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 673 - DNA, 690 bp, Arabidopsis thaliana
  G2454,family:YABBY
atgtctatgtcgtctatgtcctccccttcctcagctgtttgttcaccggaccacttctctccttccgaccatctctgctatgtccaatgcaacttttgccaaaccatccttgcggttaatgttccttacacaagcttgttcaagaccgtaactgtccgatgtggttgctgtaccaatctcctttcggtgaacatgagatcatatgtcctcccagcttctaaccagctccagctccagctcggtcctcactcttacttcaatccccaggatattctggaggagctgagagatgcaccgtctaacatgaatatgatgatgatgaatcaacatcctactatgaatgacataccatctttcatggatcttcatcaacaacatgagattcctaaagcaccacccgttaaccgccctccagagaaaagacagagagtcccatccgcatataaccgattcatcaaggaggagatccaacgtatcaaagctggtaatcctgatataagccacagagaagcctttagtgctgctgccaagaattgggcccacttcccccacatacacttcgggctcgtgccagacaatcaacccgtgaagaaaaccaacatgccccaacaggagggagaggataacatggtgatgaaagaagggttctacgctcctgcagctgctaacgttggtgtgactccttattaa

SEQ ID NO: 674 - protein, 229 aa, Arabidopsis thaliana
  G2454,YABBY domain coordinates 25-64,136-183
MSMSSMSSPSSAVCSPDHFSPSDHLCYVQCNFCQTILAVNVPYTSLFKTVTVRCGCCTNLLSVNMRSYVLPASNQLQLQLGPHSYFNPQDILEELRDAPSNMNMMMMNQHPTMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNMVMKEGFYAPAAANVGVTPY

SEQ ID NO: 675 - DNA, 590 bp, Arabidopsis thaliana
  G2457,family:YABBY
caatccattcgctaaagaccatgaacctagaagagaaaccaaccatgacggcttcaagggcttcccctcaagccgaacatctctactacgtccggtgtagcatctgcaacaccatcctcgcggttgggataccattgaagagaatgcttgacacggtaacggtgaaatgcggccattgtggtaacctctcgtttctcaccacaactcctcctcttcaaggccatgttagcctcacccttcagatgcagagctttggtggaagtgactataagaagggaagctcttcttcttcctcttcctccacctccagcgaccagcccccatctccctcacctccctttgtcgtcaaacctcctgagaagaagcagaggctcccatctgcatacaaccgcttcatgagggatgagatccaacgcatcaaaagtgccaatccggaaataccacaccgtgaagctttcagtgctgctgccaaaaattgggctaagtacatacccaactctcctacttccattacttccggaggccacaacatgatccatggcttgggattcggtgagaagaagtgaacaaaactcaggggaaaagaagcc

SEQ ID NO: 676 - protein, 181 aa, Arabidopsis thaliana
  G2457,YABBY domain coordinates 21-59,110-157
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWAKYIPNSPTSITSGGHNMIHGLGFGEKK

SEQ ID NO: 677 - DNA, 981 bp, Arabidopsis thaliana
  G246,family:MYB-(R1)R2R3
atgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctgctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgaggaagggtgggcgcgccgacccagctttcttgtacaaagttggcattataagaaagcattgctcatcaatttgttgcaacgaacaggtcactatcagtcaaaataaaatcattatttgccatccagctgatatcccctatagtgagtcgtattaa

SEQ ID NO: 678 - protein, 326 aa, Arabidopsis thaliana
  G246,MYB-(R1)R2R3 domain coordinates 57-159
MYLFMYKCNIVLEETHVFQNTPCDVSLQRPFNGFGENNALPLRKMHQEEKKKKHRGGHWTLSEDLKLKELVAVFGPQNWKFIGEKMEPRTSLSCRQRWFNQLDPKINKRNFTDEEEEKLLRAHILYGNKWSKIAKLFNRRTDHAVKNHWHSLMNRIIRKQSASDIRSFDNIQNYQTSNFLPAQCSISPRKELFFMHAIATLMSSSSLLYLPCKFLGLIHTSCLHLSTIIIIVTIIIRSRRYNDYKNPEVYRFSRGRRFLKKLLKNFLTVTLIPMMRKGGRADPAFLYKVGIIRKHCSSICCNEQVTISQNKIIICHPADIPYSESY

SEQ ID NO: 679 - DNA, 1410 bp, Arabidopsis thaliana
  G2462,family:E2F
atgtctgaagaagtacctcaacaattcccatcttctaagcggcagcttcatccttctctttcttctatgaagcctcctctagttgctcctggtgagtatcaccggtttgatgcggcggagactcgcggtggtggagctgttgctgatcaggttgtctctgacgcgattgtgatcaaatctactctgaagcgtaagacagatttggtaaaccaaatagttgaggtcaatgaattgaataccggtgttcttcaaacacctgtatcagggaaaggggggaaagccaagaaaacttctaggtctgcgaagtctaataagtctggaacgctagcttctggctctaatgcaggttctcctggaaataactttgcacaggccggtacttgtcgatatgatagttcgttaggtcttttgacaaagaaatttatcaatttgataaaacaagcagaggatggtattcttgatctaaacaaagcagctgatactttagaggtacaaaagagaaggatatatgatataaccaatgtgttagaaggaataggtttgatagagaagacgcttaagaacaggattcagtggaagggtctcgatgtctcaaaaccaggagaaacaatcgaaagcatagctaacctacaggatgaagtacaaaacctcgcagctgaggaggcaagattagatgaccaaatcagagaatcacaagaaagattaacaagcttgagtgaggatgaaaacaacaaaaggttactgttcgtcactgaaaacgacattaagaacctaccatgcttccagaataagacgctgatagctgtaaaggcaccgcatggaacaactcttgaggttccagatcctgatgaggctggtggttatcagaggaggtacagaatcattctgagaagcacaatgggaccaatagacgtgtacctagtcagtcaattcgaagagagctttgaggacattcctcaggctgatgaaccttcaaatgttcctgatgaaccctctaatgtccctgatgtaccttcaaatcttccatcaacatctggtctccctgagaaccatgatgtatctatgccgatgaaagaggaaagcaccgaaagaaacatggaaacacaggaagttgatgatacgcaaagagtttactctgacatcgaatctcatgactttgtcgatggtatcatgaagattgttcctccagatttggatatgggtgtagattactggtttcgatcagaggtaggcgaagtcagcatcacagacatgtggccagatgaatctggaccagactggaaccagatgattacatttgatcaagaccacgctggaccgagcgacaacaaaatcttggagcagccacaaactccatcgagcccaacaccagaagaatccactgctacgagatcacctacaggtagctga

SEQ ID NO: 680 - protein, 469 aa, Arabidopsis thaliana
  G2462,E2F domain coordinates 126-350
MSEEVPQQFPSSKRQLHPSLSSMKPPLVAPGEYHRFDAAETRGGGAVADQVVSDAIVIKSTLKRKTDLVNQIVEVNELNTGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPENHDVSMPMKEESTERNMETQEVDDTQRVYSDIESHDFVDGIMKIVPPDLDMGVDYWFRSEVGEVSITDMWPDESGPDWNQMITFDQDHAGPSDNKILEQPQTPSSPTPEESTATRSPTGS

SEQ ID NO: 681 - DNA, 1409 bp, Arabidopsis thaliana
  G2484,family:Z-C4HC3
tatagggctagagcgccgcccgggcaggtgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttgaagttaaataaccaaattatgaaaaggtaaagcgagttaggagaaaattatgaaagaagaaggtgaagtttccagtttataagaaatgccagtaaaagggacttagaagatgtaagcaggtaaaaaaaaaaattgtattgcttagtctttattgttggattgagactatctacagttggtgatgtcttttcttttctttttttggatttttgttgttgttaatgttaattctactactaatttgtttggtctgtttaagatattttagttctgattagtaattttttttttttttttttttctgattagtaatttgctaaaattgtaaaaactattatgtcgttatgtagtctttttattcatctttttaaaaaa

SEQ ID NO: 682 - protein, 256 aa, Arabidopsis thaliana
  G2484,Z-C4HC3 domain coordinates 202-250
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLSKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 683 - DNA, 2430 bp, Arabidopsis thaliana
  G2499,family:SWI/SNF
ttctcaatttcaattcaatctgggattcgtaaattctcggaagatgaaacgcgatttcgacgaaatctccgaggaagagtggtctcaacactcgtttaacgcttcgcgagttcttaaacgaccacggactccgaagaagactcgcgcggcgacgaatccaacgccgtcgattgagtcttttgcgtttaggagaccttcgacggcgatgacgattgagagtaatagcagcgatggtgattgtgttgagattgaggatttgggagattcggattcggatgtgaagattgtgaatggtgaggatttgttgttagaggatgaagaagaagtggaagagactaaggttgtgatgcgcgctgcgagagttggtaggagatttgtgattgaagatgaagaagcgagtgatgatgatgatgatgaggctgagagtagtgctagtgaggatgaatttggaggcggaggaggaggaagtggaggaaggagaggagaagatgaagatgttgtggggaaggcattgcaaaagtgtgctaaaatctcagcggatcttcgaaaagagctttatggtacttcttctggtgttactgatagatactctgaagttgaaacttctactgtcaggattgtcacacagaatgatattgatgatgcatgtaaagcagaggattctgattttcagcctatactcaagccgtaccagttagttggtgttaactttcttcttctgttgtataagaaaggaattgaaggagccattttagccgatgagatgggtcttggaaagaccattcaggcaatcacatatttaaccctcctaagtcgcttaaacaatgaccctggtcctcatttggttgtatgccctgcctctgtcttggaaaactgggagagagagctcagaaaatggtgtccgtcgtttactgtacttcaataccacggagctgcgagagcagcctactcaagagaattgaattctttgtcaaaagctgggaagccaccaccattcaatgtgcttcttgtgtgttactctctgtttgaacggcatagtgaacaacagaaagatgaccgaaaagtactgaaacggtggcgctggagctgtgttttgatggatgaagcccatgcgttaaaggataagaatagttataggtggaaaaacttgatgtctgtggccagaaacgcaaaccagcgtcttatgcttacaggaacgcctctacaaaatgatttgcatgaactatggtcgctgttggagttcatgttgcctgatatatttacgacagagaatgttgacttgaagaagttgttgaatgcagaagatactgagttgattactcgaatgaaatctatcttaggtcctttcatcttgaggcgtttaaaatctgatgtcatgcagcaacttgttccgaagatacagcgggttgaatatgtattaatggagagaaagcaggaagatgcatataaagaagccatagaggagtatcgtgctgcttctcaagcacggcttgtgaagctttcatcaaaatccttgaattctttagccaaggcacttccaaagcgtcaaatttcaaactattttactcaattccggaagattgcaaaccatccattgttaattaggcggatatacagcgatgaggatgtcattcgcatcgccaggaaattgcacccaatcggtgcatttggatttgaatgttccttggatagagttatcgaggaagttaagggtttcaacgatttccgtatccaccagcttttgttccaatatggagttaacgataccaaaggaactctctcagacaaacatgtcatgctctcagcaaaatgtcggacattagctgagcttctcccttcaatgaagaaatccggccatcgtgttctaatatttagtcaatggacatcgatgctcgatatcttagaatggacacttgatgtcatcggcgttacataccgaagacttgacggcagtactcaagttacagatagacaaaccatagtcgacacattcaacaacgataagtcgatattcgcatgtctcttgtcaactcgagcaggtggacaaggtcttaatttaaccggagcggatacagtcattattcacgatatggattttaatccacagattgatcggcaagctgaagatcgttgccatcgtattggtcaaacaaaaccagtcactatcttcagactggtgacgaaatcgacggttgatgagaacatctacgagatagcgaagcggaaactagttcttgatgcggcggttctagagtccggagttcacgtagatgacaacggagacacgcctgagaaaaccatgggagagattcttgcttctcttctcatgggataacattattgttaccttttttgttttgaggtaaaattagtcaagaaacgaagttaatgtgttattctaaacatgtgtaaccactagctattattaga

SEQ ID NO: 684 - protein, 763 aa, Arabidopsis thaliana
  G2499,SWI/SNF domain coordinates 209-414,618-701
MKRDFDEISEEEWSQHSFNASRVLKRPRTPKKTRAATNPTPSIESFAFRRPSTAMTIESNSSDGDCVEIEDLGDSDSDVKIVNGEDLLLEDEEEVEETKVVMRAARVGRRFVIEDEEASDDDDDEAESSASEDEFGGGGGGSGGRRGEDEDVVGKALQKCAKISADLRKELYGTSSGVTDRYSEVETSTVRIVTQNDIDDACKAEDSDFQPILKPYQLVGVNFLLLLYKKGIEGAILADEMGLGKTIQAITYLTLLSRLNNDPGPHLVVCPASVLENWERELRKWCPSFTVLQYHGAARAAYSRELNSLSKAGKPPPFNVLLVCYSLFERHSEQQKDDRKVLKRWRWSCVLMDEAHALKDKNSYRWKNLMSVARNANQRLMLTGTPLQNDLHELWSLLEFMLPDIFTTENVDLKKLLNAEDTELITRMKSILGPFILRRLKSDVMQQLVPKIQRVEYVLMERKQEDAYKEAIEEYRAASQARLVKLSSKSLNSLAKALPKRQISNYFTQFRKIANHPLLIRRIYSDEDVIRIARKLHPIGAFGFECSLDRVIEEVKGFNDFRIHQLLFQYGVNDTKGTLSDKHVMLSAKCRTLAELLPSMKKSGHRVLIFSQWTSMLDILEWTLDVIGVTYRRLDGSTQVTDRQTIVDTFNNDKSIFACLLSTRAGGQGLNLTGADTVIIHDMDFNPQIDRQAEDRCHRIGQTKPVTIFRLVTKSTVDENIYEIAKRKLVLDAAVLESGVHVDDNGDTPEKTMGEILASLLMG

SEQ ID NO: 685 - DNA, 1026 bp, Arabidopsis thaliana
  G2505,family:NAC
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 686 - protein, 341 aa, Arabidopsis thaliana
  G2505,NAC domain coordinates 9-137
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 687 - DNA, 867 bp, Arabidopsis thaliana
  G2510,family:AP2
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 688 - protein, 192 aa, Arabidopsis thaliana
  G2510,AP2 domain coordinates 42-109
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 689 - DNA, 908 bp, Arabidopsis thaliana
  G2519,family:HLH/MYC
caaagtgaaaacataagatcatcttcttcgttgatagatcaatataggaactccagaagagaatcttgatcaattaagtatcatgtctcacatcgctgttgaaaggaatcgaagaaggcaaatgaacgagcatcttaaatcccttcgttctttgactccttgtttctacatcaaaaggggagatcaagcttcgatcatcggaggagtgatagagttcatcaaagagttgcagcaattggttcaagttcttgagtccaagaaacgtcgaaagaccctaaaccgaccatctttcccttatgatcaccagacaatcgagccatccagtttaggagccgccactacccgagtaccgtttagtcgaatcgaaaatgtgatgaccacaagtactttcaaggaagtaggagcatgctgtaactcccctcatgctaacgtagaagcaaagatttcaggttctaatgttgtattgagagttgtctctaggcgaatcgtggggcagctcgtaaagatcatctctgtcttagagaagctatcttttcaagttcttcacctcaatattagtagcatggaggagactgtcttatactttttcgttgttaagataggattggagtgtcacttaagcttggaggagctaactcttgaagttcagaaaagctttgtgtctgatgaagtgatcgtctctaccaattaaaaacaaaattctacatgtactagagcgtgtatcgttttttgggattaataatcatataatcgttacatgagccttgatactttgctagaaataagctcctctaaacaaaaccttctttttaaaaaaacacacttatgttttacttagtttgttgttgtatccgaagttgatcaacgttgtaatttcccacaataaatcatgacattttatatgctct

SEQ ID NO: 690 - protein, 202 aa, Arabidopsis thaliana
  G2519,HLH/MYC domain coordinates 1-54
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 691 - DNA, 1005 bp, Arabidopsis thaliana
  G2535,family:NAC
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 692 - protein, 334 aa, Arabidopsis thaliana
  G2535,NAC domain coordinates 11-114
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 693 - DNA, 1617 bp, Arabidopsis thaliana
  G2546,family:HB
atggcagtttattacacaagtaatgtcggttgttaccagcaagaaccaatctttctcaaccatcaacaacaaaaccaacaagcttcttcttcatccgccgccgcttctttcaccgtcaccggcggcgatactgttcgaaacgagatggtttttatcccaccaaccaccacaggagacgttgtaacaggaaacggtaccgtttcaagcagcgatctaagctttcacgatggtcaaggactgtctttgagccttggtactcagatctctgttgctccgtttcactttcatcaataccaattggggtttactagtcagaatccttcaatttcagtcaaggaaacgtcaccgtttcatgtggatgagatgagtgtgaagagcaaagaaatgatcttgttgggtcaatctgatccttcctctggttatgctggtaatggtgggaatggcttctacaacaattatcggtataatgagacatcaggagggtttatgagcagcgttctgcgttctcggtatcttaaacctgctcagaatttgcttgatgaagtggttagtgtcaagaaagaactaaaccaaatggggaagaagaagatgaaagttaatgactttaacagtggttctaaggagatagaaggaggaggtggtgagttatcgagtgattcgaatgggaaatcgattgagttatctacaattgaacgtgaagagcttcagaacaagaagaacaagcttttaacaatggttgatgaggtagataaaagatataaccaatattaccatcaaatggaagcattagcttcatcatttgagatagtagcaggacttggatcagctaagccttacacatcagttgctctcaacagaatctctcgccattttcgtgctcttcgcgacgcaataaaggaacaaattcagattgttagagaaaaacttggggagaaaggaggagagtcgttggatgagcaacaaggagagaggataccaaggttgaggtatttagatcaacggttgagacagcaaagagctttgcatcaacagcttggaatggttcgacctgcttggagacctcaaagaggtcttcctgaaaactctgtctctgttcttcgcgcttggctctttgaacatttccttcatccatatccgaaagaatctgagaaaatcatgcttgcaaagcagacaggattgtcaaagaaccaggttgctaattggttcataaacgcgagagttcgtctgtggaaaccgatgatcgaagaaatgtataaagaagagtttggtgatgaatctgagttactaatctccaaatcttcccaagaacccaacagcacaaaccaagaagactcctcatcgcagcagcagcagcagcaagagaacaacaacaacagcaacctcgcttattcatctgcagacacaacaaacattgtcttctcatcagaaaccaaaccagatcgtgttctaggcaatgataacgacccacagcaacaacagataaaccgctcatcggattacgacactctgatgaactatcacgggtttggtgttgatgattaccgttacattagcggaagcaaccagcaagaaagcagattctccaattcccatcacttacacgactttgttgtgtga

SEQ ID NO: 694 - protein, 538 aa, Arabidopsis thaliana
  G2546,HB domain coordinates 349-413
MAVYYTSNVGCYQQEPIFLNHQQQNQQASSSSAAASFTVTGGDTVRNEMVFIPPTTTGDVVTGNGTVSSSDLSFHDGQGLSLSLGTQISVAPFHFHQYQLGFTSQNPSISVKETSPFHVDEMSVKSKEMILLGQSDPSSGYAGNGGNGFYNNYRYNETSGGFMSSVLRSRYLKPAQNLLDEVVSVKKELNQMGKKKMKVNDFNSGSKEIEGGGGELSSDSNGKSIELSTIEREELQNKKNKLLTMVDEVDKRYNQYYHQMEALASSFEIVAGLGSAKPYTSVALNRISRHFRALRDAIKEQIQIVREKLGEKGGESLDEQQGERIPRLRYLDQRLRQQRALHQQLGMVRPAWRPQRGLPENSVSVLRAWLFEHFLHPYPKESEKIMLAKQTGLSKNQVANWFINARVRLWKPMIEEMYKEEFGDESELLISKSSQEPNSTNQEDSSSQQQQQQENNNNSNLAYSSADTTNIVFSSETKPDRVLGNDNDPQQQQINRSSDYDTLMNYHGFGVDDYRYISGSNQQESRFSNSHHLHDFVV

SEQ ID NO: 695 - DNA, 891 bp, Arabidopsis thaliana
  G255,family:MYB-(R1)R2R3
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattc

SEQ ID NO: 696 - protein, 269 aa, Arabidopsis thaliana
  G255,MYB-(R1)R2R3 domain coordinates 14-116
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 697 - DNA, 1575 bp, Arabidopsis thaliana
  G2550,family:HB
atggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccatatcctaaagaatcagagaaaatcatgctttcaaagcagacaggactatcgaaaaaccaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaa

SEQ ID NO: 698 - protein, 524 aa, Arabidopsis thaliana
  G2550,HB domain coordinates 345-408
MAVYYPNSVGMQSLYQESIYLNEQQQQQQQASSSSAASFSEIVSGDVRNNEMVFIPPTSDVAVNGNVTVSSNDLSFHGGGLSLSLGNQIQSAVSVSPFQYHYQNLSNQLSYNNLNPSTMSDENGKSLSVHQHHSDQILPSSVYNNNGNNGVGFYNNYRYETSGFVSSVLRSRYLKPTQQLLDEVVSVRKDLKLGNKKMKNDKGQDFHNGSSDNITEDDKSQSQELSPSERQELQSKKSKLLTMVDEVDKRYNQYHHQMEALASSFEMVTGLGAAKPYTSVALNRISRHFRCLRDAIKEQIQVIRGKLGERETSDEQGERIPRLRYLDQRLRQQRALHQQLGMVRPAWRPQRGLPENSVSILRAWLFEHFLHPYPKESEKIMLSKQTGLSKNQVANWFINARVRLWKPMIEEMYKEEFGESAELLSNSNQDTKKMQETSQLKHEDSSSSQQQNQGNNNNNIPYTSDAEQNLVFADPKPDRATTGDYDSLMNYHGFGIDDYNRYVGLGNQQDGRYSNPHQLHDFVV

SEQ ID NO: 699 - DNA, 1182 bp, Arabidopsis thaliana
  G2552,family:HLH/MYC
cacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagtgatgatgtaaccgagattgttgattctctattgaataaacaccatgttatatagtaatttagcgacaaattgtatggttaaatgaagtaatatttatgttttgtttataaaa

SEQ ID NO: 700 - protein, 318 aa, Arabidopsis thaliana
  G2552,HLH/MYC domain coordinates 124-181
MEGRVNALSNINDLELHNFLVDPNFDQFINLIRGDHQTIDENPVLDFDLGPLQNSPCFIDENQFIPTPVDDLFDELPDLDSNVAESFRSFDGDSVRAGGEEDEEDYNDGDDSSATTTNNDGTRKTKTDRSRTLISERRRRGRMKDKLYALRSLVPNITKMDKASIVGDAVLYVQELQSQAKKLKSDIAGLEASLNSTGGYQEHAPDAQKTQPFRGINPPASKKIIQMDVIQVEEKGFYVRLVCNKGEGVAPSLYKSLESLTSFQVQNSNLSSPSPDTYLLTYTLDGTCFEQSLNLPNLKLWITGSLLNQGFEFIKSFT

SEQ ID NO: 701 - DNA, 2516 bp, Arabidopsis thaliana
  G2553,family:HLH/MYC
tttttttttttattagaggttggggaggagatagtataaaacaactgtttagagttctgatttgtggtttttgagtccggggttttgaggtttaccctttagaatgggttctacttctcaagagatactgaagagcttttgctttaacacggactgggactatgctgtgttctggcaacttaatcatcgaggatctcgaatggtacttaccttggaggatgcttactatgaccatcatgggacgaatatgcatggagcacatgacccccttgggttagctgtggcaaagatgtcttatcatgtctattctctaggggaagggattgtaggacaagttgcagtttctggagaacaccaatgggtatttcccgaaaattataacaactgtaactcagcatttgagtttcataacgtttgggaaagtcaaatttctgctggaattaagaccattcttgtagtagctgttggtccatgtggagttgttcagctaggctctttgtgtaaagttaatgaagatgtgaattttgtgaatcatatccgacatttatttctggcacttagggatccattggcagaccatgcagcaaatttaaggcaatgtaatatgaacaattcgttatgtctgccaaaaatgccttctgaaggtttacatgctgaggctttccctgattgctctggagaagttgacaaagctatggacgtggaagagtccaatattctaactcaatacaaaactagaagaagtgatagcatgccttacaatactccttcgtcatgtcttgtcatggagaaggcagcccaagttgttggtggtcgtgaagttgtgcaaggatctacttgtgggagttatagtggtgttacgtttggctttccagttgacttggttggtgccaaacatgagaatcaagtaggtactaatataatcagggatgcacctcatgtgggaatgactagtggctgcaaagattcaagggatttagatcctaatttacatctgtatatgaagaatcatgtgctcaatgatacaagcacatctgctttagcaattgaggctgaaagattgataacaagccaatcatatccacgcctggactcaacttttcaggctacctcgagaacagataaagaaagttcttaccataatgaagtgttccaactatctgagaaccaaggaaataaatacataaaagagactgagcgtatgctggggaggaactgcgagtctagtcaatttgatgctttgatctcatctgggtatacttttgctggcagcgagctactagaagcgttaggctctgctttcaagcaaacgaacactggtcaggaggagctactgaagtctgaacatggttcaacaatgagaccaacagacgatatgagtcatagccagctcacgtttgaccctggccctgagaatcttctagatgctgtggttgctaatgtgtgtcaaagagatggtaatgcgagggatgatatgatgtcgagcagatcggtacaatcattgcttactaacatggaactggcagaaccctcaggtcagaagaagcataatattgttaacccaattaatagtgctatgaatcagccaccaatggcagaggtggatacccaacaaaattcatcagatatttgtggagcgttttcttcaattggattctcatctacgtaccccagctcctctagtgatcagtttcagacatccctggacatacccaagaagaacaaaaagagggccaaacctggtgaaagttctcgacctcgcccaagagacaggcaacttattcaagatcgaatcaaggaacttagagaacttgtgcctaatggatctaagtgcagtatcgattctttgctagaacgaacgatcaaacacatgctctttttgcagaatgttactaagcatgctgaaaagctcagtaaaagtgctaatgaaaagatgcaacaaaaggaaactggtatgcaaggttcaagctgcgcagtggaggttggaggtcatcttcaagtaagctcgatcatcgtggagaatctgaacaagcaggggatggtgcttatcgagatgttatgtgaagaatgtggccattttcttgagatagcaaacgtcataaggagcttagacctcgtcatcctaagaggtttcaccgagactcagggcgagaaaacatggatatgctttgtaactgagagccaaaacagcaaagtaatgcagaggatggacattttgtggtctctggtgcaaatatttcaaccaaaggccaatgagaaggggtaacaggcgtggttgcagagtttgcgtttacgtaagataaagaataggcttgtgtgggcttgtacagtgttgttgtgacactcactgcaatactttcatttgtttgttttgattttttgtataaaagataggacttcaaagttgagtgtttagtgtgtttatgatttgcatttgtttgcttttgagtttttggaccctttgaagtttgtatatatacatgacttgaaactttgattttcttcataaaaaaaaa

SEQ ID NO: 702 - protein, 720 aa, Arabidopsis thaliana
  G2553,HLH/MYC domain coordinates 538-598
MGSTSQEILKSFCFNTDWDYAVFWQLNHRGSRMVLTLEDAYYDHHGTNMHGAHDPLGLAVAKMSYHVYSLGEGIVGQVAVSGEHQWVFPENYNNCNSAFEFHNVWESQISAGIKTILVVAVGPCGVVQLGSLCKVNEDVNFVNHIRHLFLALRDPLADHAANLRQCNMNNSLCLPKMPSEGLHAEAFPDCSGEVDKAMDVEESNILTQYKTRRSDSMPYNTPSSCLVMEKAAQVVGGREVVQGSTCGSYSGVTFGFPVDLVGAKHENQVGTNIIRDAPHVGMTSGCKDSRDLDPNLHLYMKNHVLNDTSTSALAIEAERLITSQSYPRLDSTFQATSRTDKESSYHNEVFQLSENQGNKYIKETERMLGRNCESSQFDALISSGYTFAGSELLEALGSAFKQTNTGQEELLKSEHGSTMRPTDDMSHSQLTFDPGPENLLDAVVANVCQRDGNARDDMMSSRSVQSLLTNMELAEPSGQKKHNIVNPINSAMNQPPMAEVDTQQNSSDICGAFSSIGFSSTYPSSSSDQFQTSLDIPKKNKKRAKPGESSRPRPRDRQLIQDRIKELRELVPNGSKCSIDSLLERTIKHMLFLQNVTKHAEKLSKSANEKMQQKETGMQGSSCAVEVGGHLQVSSIIVENLNKQGMVLIEMLCEECGHFLEIANVIRSLDLVILRGFTETQGEKTWICFVTESQNSKVMQRMDILWSLVQIFQPKANEKG

SEQ ID NO: 703 - DNA, 1894 bp, Arabidopsis thaliana
  G2554,family:HLH/MYC
gaacaaaaagcaaaactcaaaggaattttctctgtatttttttctatctgcagaaaattaaagaaaaaaagagaaaactcaaaaacccacatttttcctctgtttccagcttttctttatctttggagtttggtttctggagaagacaaaagttgttgtcctttttaagagttcgagatcctgcagaaattaaaagggctcttcccggcttggattcctaaatatgggttcagagtataagcatatattgaagagtctctgtttaagccatggatggtcttatgctgtgttttggcgttatgatcccatcaattccatgatattgagatttgaagaagcatacaatgatgaacaatcagtcgcactagttgatgatatggttctccaggctcctatcttaggccaaggaattgtgggagaagtagcttcatccggaaaccatcaatggctgttctcagacacattgtttcagtgggaacatgagtttcagaatcagtttctctgtggctttaagactatcgcaatcattccactaggatccagcggcgttgttcagctaggatctactcaaaagattcttgagagcacagagatattggaacaaacaacaagagctctccaggagacgtgtttaaagccacatgattccggtgatctcgatactctgtttgagtcactgggagattgtgagattttcccagctgaatcttttcaaggatttagctttgatgacatcttcgctgaggacaatcctccttctttgctcagccctgagatgatctcctctgaagcagcttcttccaaccaagatctgaccaatggagatgattatgggttcgacattctccagtcttactctctggacgatctataccagctgctcgctgatccaccagaacagaactgctcttccatggtgatccaaggagttgacaaggatcttttcgacattttggggatgaattctcaaacgcctacaatggctttgccacctaaaggactcttctcagagctcataagcagcagtcttagcaacaacacttgtagtagttctctcacgaacgtgcaagagtactctggtgtgaaccagagcaaaagacggaagcttgatacatcatcggcgcatagctcaagcttgttccctcaggaggagacagtaacaagtcggagtttgtggattgatgatgatgagagatcaagtattggagggaactggaagaagcctcacgaagaaggtgtgaagaagaaaagagcaaaggcaggagaaagcaggaggccgaggcctaaggaccgtcagatgatacaagaccgtatcaaggagttgcgagggatgattccaaatggagctaagtgtagcatagatacgttgctggatctgaccataaaacacatggtgttcatgcaaagcctcgccaagtatgcagagagactcaaacaaccatacgagtctaagctggtgaaggagaaagagagaacatgggcgttggaagtgggggaagaaggagtggtatgtccgataatggtggaggaattgaacagggaaggagaaatgcagatagagatggtgtgtgaggaaagagaggagttcttggagataggacaagtggtgagaggattgggattgaagatattgaaaggagtgatggaaacaagaaaaggacaaatatgggcacacttcatcgtacaggcaaagccacaagtcacaaggattcaagtcttgtactcacttgttcagctctttcaacaccacaccaaacatgatgatttattatcatagtataatacctaccactttgattttctttctttttgttacaacaacaacacaagaatctgttgataaatagtagtaacattacatcaaagaagattgtatgggctcgtggaaaaaaaa

SEQ ID NO: 704 - protein, 517 aa, Arabidopsis thaliana
  G2554,HLH/MYC domain coordinates 338-398
MGSEYKHILKSLCLSHGWSYAVFWRYDPINSMILRFEEAYNDEQSVALVDDMVLQAPILGQGIVGEVASSGNHQWLFSDTLFQWEHEFQNQFLCGFKTIAIIPLGSSGVVQLGSTQKILESTEILEQTTRALQETCLKPHDSGDLDTLFESLGDCEIFPAESFQGFSFDDIFAEDNPPSLLSPEMISSEAASSNQDLTNGDDYGFDILQSYSLDDLYQLLADPPEQNCSSMVIQGVDKDLFDILGMNSQTPTMALPPKGLFSELISSSLSNNTCSSSLTNVQEYSGVNQSKRRKLDTSSAHSSSLFPQEETVTSRSLWIDDDERSSIGGNWKKPHEEGVKKKRAKAGESRRPRPKDRQMIQDRIKELRGMIPNGAKCSIDTLLDLTIKHMVFMQSLAKYAERLKQPYESKLVKEKERTWALEVGEEGVVCPIMVEELNREGEMQIEMVCEEREEFLEIGQVVRGLGLKILKGVMETRKGQIWAHFIVQAKPQVTRIQVLYSLVQLFQHHTKHDDLLS

SEQ ID NO: 705 - DNA, 1167 bp, Arabidopsis thaliana
  G2555,family:HLH/MYC
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 706 - protein, 259 aa, Arabidopsis thaliana
  G2555,HLH/MYC domain coordinates 184-242
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 707 - DNA, 2647 bp, Arabidopsis thaliana
  G2556,family:HLH/MYC
aagggaacaagctggtagaggttcatacagaggtagttagtagattcgtagctcatctgtaggcaaaaagggtttccttttaggtggcaagactgtttattttcagacacagagactgattaagaattcaagggagagttcttgtcgggggactattttaagttttaaaaaggggtgttttttagtggtgaaggggaaggtttagatgggttataccttgcaacagatactgaggagcatctgctccaacacggattggaactacgccgtgttctggaaacttaatcaccactcgccaatggttcttactttggaggatgtgtactgtgttaatcatgagcgcggtttgatgccggaaagcttgcatggagggcgccatgctcatgaccctcttgggttagctgtggctaagatgtcatatcatgtacactctcttggggaagggattgtaggacaagtagcaatctctggacaacatcaatggatcttctctgaatatttgaatgactctcattcgacacttcaggttcacaacggttgggagagtcaaatttctgctggaattaagacaattcttatagtagctgttggttcttgcggagttgtgcagcttggctctttgtgtaaagttgaagaagacccggctttggtgactcatatcaggcatttatttttggcacttacggatccactagcagaccatgcatcaaatttaatgcaatgtgatattaacagtccatcggatcggccaaaaataccttccaaatgcttacatgaggcatcccctgatttctcaggagaatttgacaaagctatggatatggaagggttaaatattgtatctcaaaacacaagtaatagaagtaacgaccttccatacaatttcactccaacatattttcacatggagaggactgctcaagtaattggtgggcttgaagcagtccaaccttccatgtttggaagcaatgattgtgttacaagtggtttttcagttggtgtggttgatactaaacacaagaatcaagtggatataagtgatatgagtaaggtgatttatgatgaggaaacaggtggataccgatactcaagagaattagatcccaatttccaacactactcgaggaatcatgtgcgtaatagtggaggcacatctgctttagctatggagagtgataggctaaaagcaggttcatcatatccacaacttgattcaactgtacttactgcgttgaaaacagataaagattattctcgtcgaaatgaggttttccaaccatctgagagccaaggaagtatatttgtgaaagatacagaacataggcaggaggaaaaaagtgagtcaagtcagttggatgctttaactgcatctttgtgttctttttctggcagtgagctgttagaggcattagggccagcgttcagtaaaacaagcactgattatggggagctagcaaagtttgaatctgctgcagctataagacgaacaaatgatatgagccatagtcacctgacatttgaatccagctccgagaatcttctagatgccgttgttgctagtatgagtaatggtgatggtaatgtcaggcgtgaaatatcttcaagcaggtcaacacagtcattgcttacaactgctgaaatggcacaggcagaaccttttggtcataataagcaaaatattgttagcacagttgatagtgtgattagccagccgcctctagcagatgggcttatccaacagaatccatcaaatatctgcggagcattttcttccattgggttttcatcaacatgtctcagttcatccagcgaccagtttccgacgtccctggaaattcccaagaagaacaaaaagagagctaaacctggtgaaagttctcggcctcgtccaagggacaggcaacttattcaggatcgtatcaaagaactaagggagcttgtgcctaatggatctaagtgcagtattgattccttgctagagtgcacgatcaagcacatgctcttcctgcagagtgtctctcagcatgctgacaagctcactaaaagtgcaagttcaaagatgcaacacaaggataccggcaccctaggaatatcaagcactgaacaaggttcgagctgggcagtggagattggaggccatctgcaagtgtgctcaatcatggtggagaatctggacaaagaaggagtgatgcttattgagatgctatgcgaagaatgtagccactttctcgagatagcgaacgtgataaggagcttggaactcatcatcctcagaggcaccactgagaaacaaggcgagaaaacatggatatgttttgtagtggagggacaaaacaacaaagtaatgcacaggatggacatcctgtggtctcttgtgcaaatatttcaacccaaggctacaaacaggtagcaacaacgaaacccgtcacatcatgcagactcggcttcatgtatcaacaactacaaggattgaaaagcatgatgagaacagagaagaaaacgctgtgtatgtttatagtgtttgtgtgtgtgtgatactattatcttggaataggtataaaaagtctaaaggtgtgccatttttgtttggaattgttatcatgaacacttctcagattgattaatgccacaatatagcaacattcac

SEQ ID NO: 708 - protein, 734 aa, Arabidopsis thaliana
  G2556,HLH/MYC domain coordinates 546-606
MGYTLQQILRSICSNTDWNYAVFWKLNHHSPMVLTLEDVYCVNHERGLMPESLHGGRHAHDPLGLAVAKMSYHVHSLGEGIVGQVAISGQHQWIFSEYLNDSHSTLQVHNGWESQISAGIKTILIVAVGSCGVVQLGSLCKVEEDPALVTHIRHLFLALTDPLADHASNLMQCDINSPSDRPKIPSKCLHEASPDFSGEFDKAMDMEGLNIVSQNTSNRSNDLPYNFTPTYFHMERTAQVIGGLEAVQPSMFGSNDCVTSGFSVGVVDTKHKNQVDISDMSKVIYDEETGGYRYSRELDPNFQHYSRNHVRNSGGTSALAMESDRLKAGSSYPQLDSTVLTALKTDKDYSRRNEVFQPSESQGSIFVKDTEHRQEEKSESSQLDALTASLCSFSGSELLEALGPAFSKTSTDYGELAKFESAAAIRRTNDMSHSHLTFESSSENLLDAVVASMSNGDGNVRREISSSRSTQSLLTTAEMAQAEPFGHNKQNIVSTVDSVISQPPLADGLIQQNPSNICGAFSSIGFSSTCLSSSSDQFPTSLEIPKKNKKRAKPGESSRPRPRDRQLIQDRIKELRELVPNGSKCSIDSLLECTIKHMLFLQSVSQHADKLTKSASSKMQHKDTGTLGISSTEQGSSWAVEIGGHLQVCSIMVENLDKEGVMLIEMLCEECSHFLEIANVIRSLELIILRGTTEKQGEKTWICFVVEGQNNKVMHRMDILWSLVQIFQPKATNR

SEQ ID NO: 709 - DNA, 1012 bp, Arabidopsis thaliana
  G2573,family:AP2
ccagatttaatttgagactctcaaagaaacaccatggaagaagagcaacctccggccaagaaacgaaacatggggagatctagaaaaggttgcatgaaaggtaaaggcggtccagagaacgccacgtgtactttccgtggagttaggcaacggacttggggtaaatgggtggctgagatccgtgagcctaaccgtgggactcgtctctggctcggcacgtttaatacctcggtcgaggccgccatggcttacgatgaagccgctaagaaactctatggacacgaggctaaactcaacttggtgcacccacaacaacaacaacaagtagtagtgaacagaaacttgtctttttctggccacgggtcgggttcttgggcttataataagaagctcgatatggttcatgggttggaccttggtctcggccaggcaagttgttcacgaggttcttgctcagagagatcgagttttctacaagaagatgatgatcatagtcataatcgatgttcgtcttcaagtggttcgaatctttgttggttattacctaaacaaagtgattcacaagatcaagagaccgttaatgctacgactagttatggcggtgaaggcggtggtggctctacgttaacgttttcgaccaatttgaaaccaaagaatttgatgagtcagaattatggattatacaatggagcttggtctaggtttcttgtggggcaagaaaagaagacggaacatgacgtgtcatcgtcgtgtggatcgtcggacaacaaggagagtatgttggttcctagttgcggcggagagaggatgcataggccggagttggaagagcgaacaggatatttggaaatggatgatcttttggagattgatgatttaggtttgttgattggcaaaaatggagatttcaagaattggtgttgtgaagagtttcaacatccatggaattggttctgagagtttttatttattactattatttatcatacatatttcttatatttgacttagg

SEQ ID NO: 710 - protein, 307 aa, Arabidopsis thaliana
  G2573,AP2 domain coordinates 31-98
MEEEQPPAKKRNMGRSRKGCMKGKGGPENATCTFRGVRQRTWGKWVAEIREPNRGTRLWLGTFNTSVEAAMAYDEAAKKLYGHEAKLNLVHPQQQQQVVVNRNLSFSGHGSGSWAYNKKLDMVHGLDLGLGQASCSRGSCSERSSFLQEDDDHSHNRCSSSSGSNLCWLLPKQSDSQDQETVNATTSYGGEGGGGSTLTFSTNLKPKNLMSQNYGLYNGAWSRFLVGQEKKTEHDVSSSCGSSDNKESMLVPSCGGERMHRPELEERTGYLEMDDLLEIDDLGLLIGKNGDFKNWCCEEFQHPWNWF

SEQ ID NO: 711 - DNA, 1647 bp, Arabidopsis thaliana
  G2574,family:WRKY
atggaggttcttttgaaattaccctcttcagagtctcctcttaaggataaatttggatctgttcaaatccatgaagctaataagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacgatgaatgatggttgtcaatggagaaaatatggacaaaagattgcgaaaggaaatccatgtccacgagcatattatcgctgcacggttgcacctggatgtcccgttagaaaacaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctag

SEQ ID NO: 712 - protein, 548 aa, Arabidopsis thaliana [sequence omitted]

SEQ ID NO: 713 - DNA, 849 bp, Arabidopsis thaliana
  G2575,family:WRKY
atggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttga

SEQ ID NO: 714 - protein, 282 aa, Arabidopsis thaliana
  G2575,WRKY domain coordinates 137-192
MDDHVEHNYNTSLEEVHFKSLSDCLQSSLVMDYNSLEKVFKFSPYSSPFQSVSPSVNNPYLNLTSNSPVVSSSSNEGEPKENTNDKSDQMEDNEGDLHGVGESSKQLTKQGKKKGEKKEREVRVAFMTKSEIDHLEDGYRWRKYGQKAVKNSPYPRSYYRCTTQKCNVKKRVERSFQDPSIVITTYEGKHNHPIPSTLRGTVAAEHLLVHRGGGGSLLHSFPRHHQDFLMMKHSPANYQSVGSLSYEHGHGTSSYNFNNNQPVVDYGLLQDIVPSMFSKNES

SEQ ID NO: 715 - DNA, 1746 bp, Arabidopsis thaliana
  G2577,family:AP2
atgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggcatcggtggacaggtagatacgaggcacatttatgggacaatagttgcaaaagagaaggccagactcgcaaaggaagacaaggaggttatgacaaagaagaaaaagcagctagggcttacgatttagccgcactaaagtattggggaaccaccactactactaacttccccttgagtgaatatgagaaagaggtagaagagatgaagcacatgacgaggcaagagtatgttgcctctctgcgcaggaaaagtagtggtttctctcgtggtgcatcgatttatcgaggagtaacaaggcatcaccaacatggaaggtggcaagctaggatcggaagagtcgccggtaacaaagacctctacttgggaactttcggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttag

SEQ ID NO: 716 - protein, 581 aa, Arabidopsis thaliana
  G2577,AP2 domain coordinates 208-281,307-375
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 717 - DNA, 1276 bp, Arabidopsis thaliana
  G2579,family:AP2
ccaaaaaaaaacttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgttgttaactatatgttatcgactttattatataaatcctgcttattgtttcatgcatcataa

SEQ ID NO: 718 - protein, 348 aa, Arabidopsis thaliana
  G2579,AP2 domain coordinates 52-119
MSTSKTLDHNKPFETSQTQMGFALIHQNTSANTTTTTTTGERRGRRSKQAEPGRFLGVRRRPWGRYAAEIRDPTTKERHWLGTFDTAHEAALAYDRAALSMRGTQARTNFVYTPTDVHTILTNPNLHSLIVSPYNNNQSFLPNSSPQFVIDHHPHYQNYHQPQQPKHTLPQTVLPAASFKTPVRHQSVDIQAFGNSPQNSSSNGSLSSSLDEENNFFFSLTSEEHNKSNNNSGYLDCIVPNHCLKPPPEATTTQNQAGASFTTPVASKASEPYGGFSNSYFEDGEMMMMNHHEFGSCDLSAMITNYGAAAASMSMEDYGMMEPQDLSSSSIAAFGDVVADTTGFYSVF

SEQ ID NO: 719 - DNA, 998 bp, Arabidopsis thaliana
  G258,family:MYB-(R1)R2R3
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 720 - protein, 307 aa, Arabidopsis thaliana
  G258,MYB-(R1)R2R3 domain coordinates 24-124
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 721 - DNA, 788 bp, Arabidopsis thaliana
  G2582,family:MADS
attccaagtgatccttagccatggctcggaaaaaagtacgagctgcatggatccgtgacgataggatgaggagggcaagcctcaagaggaggttaacggggcttatcaaaaaagtgaatgaactgtccattctgtgcgatatgcgcgctagtgtggtcgttttcaatcgagaagaagaacaattgacggcgtggccatctcccgaggcagctaattcactcatcgacaacttttattctctaaccgaccatgaaaggaccatgaaggccgttgatccggagtcatacgtccagaccgttatcgaaaagattgagaagaaacgagccgatactcggaaggttatcacggagtttgagatggacgaactcatgttccaagtccaaaatggtcgtgaacttgctgatctctccccaaccgaggctgataaactaataccatatgcggataagaaacttatgtggttgagtaaacggatgggttctacgggggtcgacgccctgagggcttcgaatgttgcgtctgggtcaggtggaaatgggttaaacatgatggaaactggaagaagtttctattatgttgataaatgggtcttcgttgatccacaagtccaaaacccttgtgatgttgagactcatttacccacaatggtcagtggcttagacctaaacatggaaccatctgatgaagacttggggacctataaaggagagagcagcatggccggtggtgctgaagacgatgccgaatgaagctgccgtcaaagtgacatgacacttgcggcgcctcga

SEQ ID NO: 722 - protein, 242 aa, Arabidopsis thaliana
  G2582,MADS domain coordinates 1-57
MARKKVRAAWIRDDRMRRASLKRRLTGLIKKVNELSILCDMRASVVVFNREEEQLTAWPSPEAANSLIDNFYSLTDHERTMKAVDPESYVQTVIEKIEKKRADTRKVITEFEMDELMFQVQNGRELADLSPTEADKLIPYADKKLMWLSKRMGSTGVDALRASNVASGSGGNGLNMMETGRSFYYVDKWVFVDPQVQNPCDVETHLPTMVSGLDLNMEPSDEDLGTYKGESSMAGGAEDDAE

SEQ ID NO: 723 - DNA, 750 bp, Arabidopsis thaliana
  G2586,family:WRKY
atgttctccaacatcgatcaaacagctgtggcagcactcctccgtggccaaggatgcgctaacagtctcaagaggctcctcgaaaaccacaagttaagctcagattcaacagagccgctcatctacaccatactcaattctttctcacttgctctctcttttgtggacccgcctagtcttctaccacacaatgagtcttctcttcaaaacatgacaagtcatgttcttcagagatcatcaaagaaaaaatattatggagcagaagatttagagtattacagagacgaatccccgactccacgccccgatgacggcttcacctggaggaaatatggacaaaaaactatcaaaacctcaccgtaccaaaggtgttactatcggtgtacctatgcaaaagaccaaaactgcaatgctagaaagcgggtgcagatgatccaagataaccctccagtgtacagaactacttatttgggaaaacatgtgtgtaaagctgttgcagttcatgatgatacatatggttctgaaatgataaaattcgaccaagttgtatctgaatcggttatgcctcaactcgcaacaattgacgaacaagcaattaccatggaggacgaagccatagaccatatcatgaaccaagaatgtgatattaatgatttttctgtggatgatgacccattttgggctagtcaatttcctccattttcatcggaagacattatgttttttgacaatattgctaatcttgattag

SEQ ID NO: 724 - protein, 249 aa, Arabidopsis thaliana
  G2586,WRKY domain coordinates 103-160
MFSNIDQTAVAALLRGQGCANSLKRLLENHKLSSDSTEPLIYTILNSFSLALSFVDPPSLLPHNESSLQNMTSHVLQRSSKKKYYGAEDLEYYRDESPTPRPDDGFTWRKYGQKTIKTSPYQRCYYRCTYAKDQNCNARKRVQMIQDNPPVYRTTYLGKHVCKAVAVHDDTYGSEMIKFDQVVSESVMPQLATIDEQAITMEDEAIDHIMNQECDINDFSVDDDPFWASQFPPFSSEDIMFFDNIANLD

SEQ ID NO: 725 - DNA, 896 bp, Arabidopsis thaliana
  G259,family:HS
gagatcttctactacttgttttcttcaagaataataattttcgttttatatatggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatgaaactagattgctagattgatattcgtaatataccagtttcttcatattcttagaagttttgcataactatatatagtactcttttaagacatgcaagatcagaacatatg

SEQ ID NO: 726 - protein, 244 aa, Arabidopsis thaliana
  G259,HS domain coordinates 40-131
MEDAGEHLRCNDNVNDEERLPLEFMIGNSTSTAELQPPPPFLVKTYKVVEDPTTDGVISWNEYGTGFVVWQPAEFARDLLPTLFKHCNFSSFVRQLNTYGFRKVTTIRWEFSNEMFRKGQRELMSNIRRRKSQHWSHNKSNHQVVPTTTMVNQEGHQRIGIDHHHEDQQSSATSSSFVYTALLDENKCLKNENELLSCELGKTKKKCKQLMELVERYRGEDEDATDESDDEEDEGLKLFGVKLE

SEQ ID NO: 727 - DNA, 1084 bp, Arabidopsis thaliana
  G26,family:AP2
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 728 - protein, 218 aa, Arabidopsis thaliana
  G26,AP2 domain coordinates 67-134
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 729 - DNA, 549 bp, Arabidopsis thaliana
  G2604,family:Z-LSDlike
tcgacgagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatc

SEQ ID NO: 730 - protein, 154 aa, Arabidopsis thaliana
  G2604,Z-LSDlike domain coordinates 34-64,73-103
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 731 - DNA, 879 bp, Arabidopsis thaliana
  G2606,family:Z-C2H2
atgacaagtgttcttgaggagagtggagaccacgcgcgtcttgttctcctcatcaagggcaaacgcaccaaacgtcagcgttctgcgtctcctcttatgatgaacgctgctgcagtatccagcgtttgtagcggtgaacgatcatcagtggaggtaagagaagaagaagctgctggtgaagtagaattccaaggagctaccgatgaagacgaagatatggcgaattgtctgatcttgttgtcgcaaggacatcaagcaaagagcagcgacgatcatttgtcgatgcagagaatgggtttctttagcaacaagaaaccggtggcttctctagggttagggctagacggtgtttaccagtgcaaaacgtgtgataaaagcttccattcgttccaagcgctaggagggcacagggctagtcacaagaagccaaaacttggagctagcgttttcaaatgcgtcgagaagaaaacggcgtctgcgtctacggttgaaacagtggaagctggagccgtaggaagctttctttccctacaagtgactagtagtgatggtagcaagaaaccggagaaaacacatgaatgttcaatctgcaaggccgagttttcttcaggacaagccttaggaggacatatgaggagacatagaggtttaacaataaacgcaaacgctacttcagcaatcaaaacagcgatatcatcatcaagtcatcatcaccatgaagaatctatacggccaaagaactttctccagttagatctgaatcttccagcacccgaagatgaacgatgctgcgagaaaccgaaattcgcgtttgcatccaaagatcagattcttctcttcacggccgcgtcaaattctttgattgattgtcatcactaa

SEQ ID NO: 732 - protein, 292 aa, Arabidopsis thaliana
  G2606,Z-C2H2 domain coordinates 120-140,192-214
MTSVLEESGDHARLVLLIKGKRTKRQRSASPLMMNAAAVSSVCSGERSSVEVREEEAAGEVEFQGATDEDEDMANCLILLSQGHQAKSSDDHLSMQRMGFFSNKKPVASLGLGLDGVYQCKTCDKSFHSFQALGGHRASHKKPKLGASVFKCVEKKTASASTVETVEAGAVGSFLSLQVTSSDGSKKPEKTHECSICKAEFSSGQALGGHMRRHRGLTINANATSAIKTAISSSSHHHHEESIRPKNFLQLDLNLPAPEDERCCEKPKFAFASKDQILLFTAASNSLIDCHH

SEQ ID NO: 733 - DNA, 1904 bp, Arabidopsis thaliana
  G261,family:HS
gctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcat

SEQ ID NO: 734 - protein, 401 aa, Arabidopsis thaliana
  G261,HS domain coordinates 15-106
MDENNHGVSSSSLPPFLTKTYEMVDDSSSDSIVSWSQSNKSFIVWNPPEFSRDLLPRFFKHNNFSSFIRQLNTYGFRKADPEQWEFANDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 735 - DNA, 795 bp, Arabidopsis thaliana
  G2616,family:HB
tcacttccacattgtcttcttcatatggtaaaaaggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttagggattgagcatttgttgaatagggacaagtttatagactgagtgaaacaaagatgatgaactctccaacctctctgtttttatttggttttctcaataaattgatatcatcgtatatgattgtgtgagggagaccttgaacaagtttttttttactgtagaatttgtttttccg

SEQ ID NO: 736 - protein, 197 aa, Arabidopsis thaliana
  G2616,HB domain coordinates 79-139
MEQESLNGRYGSRVMTDEQMETLRKQIAIYAVLCDQLVFLHNSLSSVPLLSSGMNPMRGEYFDPMVASSSAHGMSTRPRWTPTTTQLQILENIYKEGSGTPNPRRIKEITMELSEHGQIMEKNVYHWFQNRRARSKRKQPPTTTITSSQADDAAVTTTEERGRCGDDSGGFESYEHILFPSPDLGIEHLLNRDKFID

SEQ ID NO: 737 - DNA, 1574 bp, Arabidopsis thaliana
  G262,family:HS
atgtttgtaaatttcaaatacttctctttctttatccgtacgaaaatggacggtgttaccggcggaggaacgaatatcggcgaggctgtgacggcgccaccaccgcggaatccgcatccagcgactttacttaatgcgaactctttaccgccccctttccttagcaagacgtatgacatggtggaagatccggcgacggacgcgattgtctcatggagtccgacgaacaatagcttcattgtttgggatccaccggagttttctcgtgatcttctacctaaatacttcaaacacaacaatttctccagctttgttcgccagttaaacacctatggttttaggaaagtggatccagatcgatgggaatttgctaatgaaggtttcttaagaggtcaaaaacatctattgaagaagataagccggagaaaatctgttcagggacatggtagtagtagtagtaatccacaatctcagcaattatctcagggtcaaggttcaatggctgcattatcttcatgtgttgaggttgggaaatttgggttagaggaagaagttgaacagcttaaaagagacaaaaacgtgttgatgcaggaactcgttaagttacgccagcagcaacaaacaacagataataaacttcaggttttggttaaacatcttcaggttatggagcagaggcaacaacagattatgtctttccttgctaaagctgtacagaatcctactttcctctctcagtttatacagaagcagactgatagtaatatgcatgtaaccgaggccaataagaagcggagactcagagaggatagtactgctgctactgagagtaatagtcatagccatagcttggaagcatcagatggacagatagttaagtatcagccacttagaaacgattcaatgatgtggaacatgatgaaaacagatgataagtatccgtttcttgacgggttctcatctccaaaccaggtatcaggagtcactcttcaagaggtactacccataacttcaggacagtcacaggcatatgcatctgtaccatcaggacagcctttatcatacttaccctctacttcaacttctctcccggataccataatgccagagacttcccagataccacaattgacacgagagagtatcaacgacttccctacagaaaacttcatggatacagagaagaatgttccagaggcattcatctctccaagcccattccttgatggtggttcagtcccgattcagcttgagggaatacccgaagaccccgagattgatgaactaatgagtaactttgaattccttgaagaatatatgccagaaagcccagtttttggagatgcaactacactagagaacaacaacaacaacaacaacaacaacaacaacaacaacaacaacaacaacaacaacaacacaaatggtagacatatggataagcttatagaagaattgggtcttctcacatcagaaacagaacactagtaaaggattatgtttagtatccattgtaaagtctttctctactaacattatcgttaggacgcgaacgctctagacaggaaaagtcc

SEQ ID NO: 738 - protein, 495 aa, Arabidopsis thaliana
  G262,HS domain coordinates 52-143
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 739 - DNA, 1751 bp, Arabidopsis thaliana
  G2620,family:TH
ttgtcatatacagagagagaagagaaacctgaggaagctgaccggagaagacgaaagcaaacttttttctgaagaaatttgatccaaaaatggatgggaattttccacaaggaggtgtagttcgtagtggagcttcatcttatggaggatttgatttacaaggttctatgagagttcatcaccaagactccatgaatcagcagcatcgacacaatcctaattctagaccacttcatgaaggtcttccctttactatggttacaggtcaaacctgtgatcatcatcagaatcagaacatgtctatgtctgagcaacagaaagctgaaagagagaagaattcagtgagtgatgatgatgaaccaagtttcacagaggaaggtggtgatggtgttcataatgaagctaatagatcaactaaaggatctccatggcaacgagtgaaatggactgataagatggtgaagttgttgattactgctgtttcttatataggagatgattcgagtatagatagtagtagtagaagaaagtttgctgttttgcagaagaaagggaagtggaaatctgtttctaaagttatggctgagagaggttatcatgtttcgccgcagcaatgtgaggataagttcaatgatttgaataaacggtataagaagcttaatgatatgcttggtagaggaacatcttgtcaagttgttgagaatcctgcgcttttggattcgattggttacttgaatgataaagagaaggatgatgttaggaagattatgagttctaaacatcttttttatgaagagatgtgttcgtatcataatgggaataggttgcatttgcctcatgaccttgctttgcagcgttcgttacagttggcgcttagaagcagagatgatcatgataatgatgattctaggaaacatcaaatggaggatcttgatgatgaggatcatgatggtgatggtgatgaacatgatgagtatgaggagcaacattatgcgtatggagattgtagggtaaatcattatggaggtggtggtggtcctttgaagaagataagaccaagccttagccatgaagatggagatcatccgagtcatgtgaattctctggagtgtaataaagtctctttacctcaaataccgttttctcaagctgatgtgaatcaaggtggggcggagagtggaagagcaggttcggtgcagaagcagtggatggagtcgcggactctccagctagaagagcagaagcttcagatccaagttgaattgctggaattggagaaacagagattcaggtggcagaggtttagcaagaaaagggatcaagaactcgagagaatgagaatggagaatgaaaggatgaaacttgagaatgatcggatgggattggagttgaaacaaagggaattgggtgttgaattataacggaattggcttcacttctcttgattggtatatagctttgctaaatgaagtctcattttctgcttttgtaagcttgctttgattggaatgatctcgagactttgatgtgagagatctttgtggttgcatcagtgatgaagtttgtgaatgtagtgagaaaggagtggttaatataagcagctctctaaggtttgttttaactctacttctcagtactcaactggttaaggttattttcattgttctgctgtattgttttcgacatcttaatccaatgtgtaacaaatatctcattgttaagccagtttgagaatgagttgttgctaacta

SEQ ID NO: 740 - protein, 443 aa, Arabidopsis thaliana
  G2620,TH domain coordinates 118-193
MDGNFPQGGVVRSGASSYGGFDLQGSMRVHHQDSMNQQHRHNPNSRPLHEGLPFTMVTGQTCDHHQNQNMSMSEQQKAEREKNSVSDDDEPSFTEEGGDGVHNEANRSTKGSPWQRVKWTDKMVKLLITAVSYIGDDSSIDSSSRRKFAVLQKKGKWKSVSKVMAERGYHVSPQQCEDKFNDLNKRYKKLNDMLGRGTSCQVVENPALLDSIGYLNDKEKDDVRKIMSSKHLFYEEMCSYHNGNRLHLPHDLALQRSLQLALRSRDDHDNDDSRKHQMEDLDDEDHDGDGDEHDEYEEQHYAYGDCRVNHYGGGGGPLKKIRPSLSHEDGDHPSHVNSLECNKVSLPQIPFSQADVNQGGAESGRAGSVQKQWMESRTLQLEEQKLQIQVELLELEKQRFRWQRFSKKRDQELERMRMENERMKLENDRMGLELKQRELGVEL

SEQ ID NO: 741 - DNA, 912 bp, Arabidopsis thaliana
  G2632,family:CAAT
atgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatga

SEQ ID NO: 742 - protein, 303 aa, Arabidopsis thaliana [sequence omitted]

SEQ ID NO: 743 - DNA, 996 bp, Arabidopsis thaliana
  G2639,family:SRS
atggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactcaagatcttga

SEQ ID NO: 744 - protein, 331 aa, Arabidopsis thaliana
  G2639,SRS domain coordinates 114-167
MAGFFSLGHGGGGNTPDNHRTNTNNPSSSGTESWLWCRNPNSNADGGEAGPSYKGTLELWQHPNNQEIIFQQQQQQQQRLDLYTSAAGLGVGPSNRSLIETSGGALMMMRSGSGSGGPSCQDCGNQSKKDCSHMRCRTCCKSRGLDCPTHVKSTWVPAAKRRERQQQLSTGQQPQQLGGSVPKRQRERIPARSTSMAYTRIPSNNTSGLEVGNFPPEVSSSAVFRCVRVSSVDDEEEEYAYKTAVSIGGHVFKGVLYDQGPAERSSSGGGSQPLNLITAGPSASSSSPNVSCNNGVVGSTSDHYIDPASLNYPTPINTFMTGTHFFSNSRS

SEQ ID NO: 745 - DNA, 1613 bp, Arabidopsis thaliana
  G264,family:HS
cttgtaccagtttctgattagattcaacaatgaacggcgcattaggtaactcctccgcctccgttagcggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaaggatcagaagcatcttctcaagaatatacatagaaggaaacctatacacagccacagtcatccacctgcttcgtcgactgatcaagaaagagcagtgttgcaagagcaaatggacaagctttcacgtgagaaagctgcaattgaagctaagcttttaaagttcaaacaacagaaggttgtagcaaagcatcagtttgaagaaatgactgagcatgttgatgatatggagaataggcagaagaagctgctgaattttttggaaactgcgattcggaatcctacttttgttaagaattttggtaagaaagtcgagcagttggatatttcagcttacaacaaaaagcgaaggctccctgaagttgagcaatcaaagccaccttcagaagattctcatctggataatagtagtggtagctcgagacgcgagtctggaaacatttttcatcaaaatttctctaataaattgcgactagagctttctccagctgattcagatatgaacatggtttcacacagtatacaaagttccaatgaagaaggtgcgagtcccaaagggatactgtcaggaggtgatccaaatactacactaacaaaaagagaaggcctaccatttgcacctgaagctctagagcttgcggataccgggacatgcccgaggagattactgttaaatgataatacaagggtggagaccttgcagcagaggctaacttcttcagaggagactgatggtagcttttcatgtcatttaaatctaaccctggcttctgctccgttaccggacaaaacagcttcacagatagctaagacgactcttaaaagtcaggagttaaactttaactcaatagaaacaagtgcaagtgagaaaaatcggggtagacaagagattgcagttggaggtagccaagcaaatgcagctcctccagcaagagtgaatgatgtattctgggaacagttcctaacagaaaggccagggtcttcagataatgaggaggcaagttcgacttatagaggtaacccatacgaagagcaagaggagaaaagaaacgggagtatgatgttacgtaatacaaagaatatcgagcagctgaccttataaactatttggacggttacatcaacgagagtacgaactgaggttttggtaagaagtatgggtgagtaagtaatgaaacattggactgaaaaagcgtaagtagctttgttgtaaacacttgcgtctctgtctacacaagtaatttgactgtaaatgtaagtgtacaggatttaaattgaataagca

SEQ ID NO: 746 - protein, 466 aa, Arabidopsis thaliana
  G264,HS domain coordinates 23-114
MNGALGNSSASVSGGEGAGGPAPFLVKTYEMVDDSSTDQIVSWSANNNSFIVWNHAEFSRLLLPTYFKHNNFSSFIRQLNTYGFRKIDPERWEFLNDDFIKDQKHLLKNIHRRKPIHSHSHPPASSTDQERAVLQEQMDKLSREKAAIEAKLLKFKQQKVVAKHQFEEMTEHVDDMENRQKKLLNFLETAIRNPTFVKNFGKKVEQLDISAYNKKRRLPEVEQSKPPSEDSHLDNSSGSSRRESGNIFHQNFSNKLRLELSPADSDMNMVSHSIQSSNEEGASPKGILSGGDPNTTLTKREGLPFAPEALELADTGTCPRRLLLNDNTRVETLQQRLTSSEETDGSFSCHLNLTLASAPLPDKTASQIAKTTLKSQELNFNSIETSASEKNRGRQEIAVGGSQANAAPPARVNDVFWEQFLTERPGSSDNEEASSTYRGNPYEEQEEKRNGSMMLRNTKNIEQLTL

SEQ ID NO: 747 - DNA, 1113 bp, Arabidopsis thaliana
  G2640,family:SRS
atggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatga

SEQ ID NO: 748 - protein, 370 aa, Arabidopsis thaliana
  G2640,SRS domain coordinates 146-189
MAGFFSLDGGGGGGGGGGNNQEDHRSNTNPPPPVSEAWLWYRNPNVNANANTNVNANAPSSSNAALGTLELWQNHNQQEIMFQHQQHQQRLDLYSSAAGLGVGPSNHNQFDISGETSTAGAGRAAAMMMIRSGGSGGGSGGVSCQDCGNQAKKDCSHMRCRTCCKSRGFECSTHVRSTWVPAAKRRERQQQLATVQPQTQLPRGESVPKRHRENLPATSSSLVCTRIPSHSGLEVGNFPAEVSSSAVFRCVRVSSVEDGEEEFAYQTAVSIGGHIFKGILYDLGPGSSGGGGYNVVAAGESSSGGGGAQQLNLITAGSVTVATASSSTPNLGGIGSSSAAAATYIDPAALYPTPINTFMAGTQFFPNPRS

SEQ ID NO: 749 - DNA, 1470 bp, Arabidopsis thaliana
  G265,family:HS
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 750 - protein, 345 aa, Arabidopsis thaliana
  G265,HS domain coordinates 13-104
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 751 - DNA, 822 bp, Arabidopsis thaliana
  G2650,family:TEO
tcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgt

SEQ ID NO: 752 - protein, 242 aa, Arabidopsis thaliana
  G2650,TEO domain coordinates 34-91
MGIKKEDQKSSLSLLTQRWNNPRIVRVSRAFGGKDRHSKVCTVRGLRDRRIRLSVMTAIQVYDLQERLGLSQPSKVIDWLLEVAKNDVDLLPPLQFPPGFHQLNPNLTGLGESFPGVFDLGRTQREALDLEKRKWVNLDHVFDHIDHHNHFSNSIQSNKLYFPTITSSSSSYHYNLGHLQQSLLDQSGNVTVAFSNNYNNNNLNPPAAETMSSLFPTRYPSFLGGGQLQLFSSTSSQPDHIE

SEQ ID NO: 753 - DNA, 1413 bp, Arabidopsis thaliana
  G2655,family:HLH/MYC
atcaaaccacaactttgtttgacctttttttgagtacttctcttgtcttttcttcttcaagtttacttagttctttgagaacaaatttctgttgattttttttctttcttgtagagggataattacaagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctctaatttttcatgtgtgatcttttgctctctctttttcatatattaaataatataaatttcctttttctttttgttaacgttaattctaatgcattatatattggagtttttg

SEQ ID NO: 754 - protein, 320 aa, Arabidopsis thaliana
  G2655,HLH/MYC domain coordinates 119-178
MALEAVVYPQDPFSYISCKDFPFYDLYFQEEEDQDPQDTKNNIKLGQGQGHGFASNNYNGRTGDYSDDYNYNEEDLQWPRDLPYGSAVDTESQPPPSDVAAGGGRRKRRRTRSSKNKEEIENQRMTHIAVERNRRKQMNEYLAVLRSLMPPYYAQRGDQASIVGGAINYLKELEHHLQSMEPPVKTATEDTGAGHDQTKTTSASSSGPFSDFFAFPQYSNRPTSAAAAEGMAEIEVTMVESHASLKILAKKRPRQLLKLVSSIQSLRLTLLHLNVTTRDDSVLYSISVKVEEGSQLNTVEDIAAAVNQILRRIEEESSFS

SEQ ID NO: 755 - DNA, 1255 bp, Arabidopsis thaliana
  G2656,family:DBP
aggttacacgaattattaaaacctaatcattgattatttattcctgaccttgtttcttctccttccatcacctaattataatcagacctaaactagctaattacaacactccactactactactactacaactcttctgatgttgactttgtacggtcaagaaaggtcaccggagaactccaccacaagtacgaccgatgcttccgatcgccgggatgagacgccgtcgtcggagatagtcgtgagagatattcacgcgatgacgacgacgacagagcttactcggccacaacaaaggggatcaggaggaggatacttgtctccgtcgaggtctattgcttttagcgacggaactacttcttccggtgagaatttcaccaccgtgagcagagagttcaacgctctagtcatcgccggatcttccatggacaacaacagtaacggaactaaccaatcaggtggtcatcgtgacgtcatacgtgatgaaagaaacgagctgactaggatcggcgaaaacgatgacgttggtgatcatggtcaggtgcctgaggaggattcaaatccatgggcgattgtaccggacgattacaacaaccgggacggttcagagaataatattgtgttggcgtcatcaggtggtcagaaccggatggtgacgactgcttcggtgcagagggtgaagagagaagaggtggaagcaaagataacggcgtggcaaacggcgaaggtggctaagattaataataggtttaagagacaagacgccgttattaacggttggttgaatgagcaggttcatagagctaactcttggatgaagaaaatcgagaggaaactggaagataggagagcgaaggcgatggagaaaacacaaaacaaagtggcaaaagctcagaggaaggcggaggagaggagagccacggcggaaggtaaacgagggacggaggttgcgagggttcttgaagttgctaatctcatgagagccgttggacgacctccggccaaacgatcattcttctctctttcctagctaagctattactagttttagttacatccaaatgtctcaatatatataggctaccattttctgttgggaatcaatgtgtatataactatatatagaatgtaagagttttaaaggtactgatatattttgtaattgtatgcttttttctttgtctgcaccacataaaaactaataaaatgttatttgtaagccaagaaaattgtttacatgtattgttttgtcatc

SEQ ID NO: 756 - protein, 296 aa, Arabidopsis thaliana
  G2656,DBP domain coordinates 173-292
MLTLYGQERSPENSTTSTTDASDRRDETPSSEIVVRDIHAMTTTTELTRPQQRGSGGGYLSPSRSIAFSDGTTSSGENFTTVSREFNALVIAGSSMDNNSNGTNQSGGHRDVIRDERNELTRIGENDDVGDHGQVPEEDSNPWAIVPDDYNNRDGSENNIVLASSGGQNRMVTTASVQRVKREEVEAKITAWQTAKVAKINNRFKRQDAVINGWLNEQVHRANSWMKKIERKLEDRRAKAMEKTQNKVAKAQRKAEERRATAEGKRGTEVARVLEVANLMRAVGRPPAKRSFFSLS

SEQ ID NO: 757 - DNA, 819 bp, Arabidopsis thaliana
  G2661,family:HLH/MYC
accatatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaaaaagagagtatacaatactgtatattaattatggactttaaaaaa

SEQ ID NO: 758 - protein, 171 aa, Arabidopsis thaliana
  G2661,HLH/MYC domain coordinates 40-97
MDDFNLRSENPNSSSTTSSSSSSFHRHKSETGNTKRSRSTSTLSTDPQSVAARDRRHRISDRFKILQSMVPGGAKMDTVSMLDEAISYVKFLKAQIWYHQNMLLFINDHETTSSCTYSPGAGEFGPKLFGYDDDYAPIMDTYSQGVPLTVADSKYTPWFGSVDDEQERDSS

SEQ ID NO: 759 - DNA, 2049 bp, Arabidopsis thaliana
  G2674,family:HB
atgaatggcgatcttgaagttgatatgtctagaggagatttcaatccaagtttttttcttggaaagcttaaagacgatgagtttgagagtagatcattgagtgatgatagctttgatgcaatgtctggtgatgaggataaacaagaacaacgccctaagaagaagaagaggaagacaaagtatcatagacacacttcttaccagattcaagaactcgaatctttcttcaaagagtgtcctcatcctaatgagaagcaaaggttggaacttggcaaaaaacttactttggagagtaagcaaattaagttttggtttcagaacagaagaacacaaatgaagacgcaactagagcggcatgagaatgtgattctcaaacaagagaatgaaaaactgcggctagaaaacagtttccttaaagagtcaatgagaggctctctatgtattgattgtggtggagcagttatacctggtgaggtttcttttgagcagcaccaacttaggattgagaatgctaagcttaaggaagagcttgataggatttgtgctttagcaaatagattcattggtgggtctatttcacttgagcagccttcaaatggtgggattggctcacagcatttgcctataggacattgtgtcagtggtggaacttcactgatgtttatggatcttgccatggaagccatggatgagttgttgaagttagcagaattggaaacttctttatggagttcaaagagtgagaaaggatcgatgaaccatttccctggttcaagagaaactggtttagtacttatcaatagcttggctctagtcgagactcttatggacacgaacaaatgggcagaaatgtttgagtgcatagtcgcggttgcatcaacccttgaagtgatatccaacggtagtgatggatcaagaaacggctctattctattgatgcaagcagagtttcaagtgatgtctccattagttccaatcaaacaaaagaagtttcttagatattgcaagcaacatggagatggtttatgggcggtcgtcgatgtttcttatgatataaacagaggaaatgagaacttgaagtcttatggtggctctaaaatgtttccttcaggatgcattatacaagacataggcaacggctgctccaaggtgacatggatagaacattcagagtacgaagagagtcacacccactcactttaccaaccgttgctcagttcttcggttgggttaggcgcaaccaaatggcttgcgactctgcagaggcaatgcgagagcttcacaatgcttttgtcttctgaagatcacacaggtttgtcacatgctggaacaaagagtatactaaagctagcgcagcgtatgaagctcaacttttactcgggaataactgcttcgtgcattcacaaatgggagaagcttcttgctgagaacgtgggacaggacacaaggatactgacaaggaagagtcttgagccgtctggtattgtcctgagcgctgcgacatctctgtggctaccagtgactcagcagagactctttgagtttctgtgtgatggtaaatgcagaaaccagtgggatattttgtctaatggtgcttcaatggaaaacacacttctcgtcccaaaaggacaacaggaaggaagctgcgtctctcttcttcgtgctgctgggaatgatcaaaatgagagtagtatgctcatcttgcaagagacatggaatgacgtttctggtgcactggtggtttacgcgcctgttgatattccatctatgaatactgtaatgagcggtggagattcagcttatgtggcgcttcttccatcggggttctcgatattgcctgacggatcatcatcatcgtctgatcagttcgataccgatggcggtttggtgaatcaagaaagcaaaggatgtctcctgactgtaggatttcagatcttagtgaacagcctaccgactgcaaaactcaacgtggaatctgttgaaactgttaacaacctcatcgcttgcaccattcacaagatcagagccgctcttcgtatacctgcttag

SEQ ID NO: 760 - protein, 682 aa, Arabidopsis thaliana
  G2674,HB domain coordinates 56-116
MNGDLEVDMSRGDFNPSFFLGKLKDDEFESRSLSDDSFDAMSGDEDKQEQRPKKKKRKTKYHRHTSYQIQELESFFKECPHPNEKQRLELGKKLTLESKQIKFWFQNRRTQMKTQLERHENVILKQENEKLRLENSFLKESMRGSLCIDCGGAVIPGEVSFEQHQLRIENAKLKEELDRICALANRFIGGSISLEQPSNGGIGSQHLPIGHCVSGGTSLMFMDLAMEAMDELLKLAELETSLWSSKSEKGSMNHFPGSRETGLVLINSLALVETLMDTNKWAEMFECIVAVASTLEVISNGSDGSRNGSILLMQAEFQVMSPLVPIKQKKFLRYCKQHGDGLWAVVDVSYDINRGNENLKSYGGSKMFPSGCIIQDIGNGCSKVTWIEHSEYEESHTHSLYQPLLSSSVGLGATKWLATLQRQCESFTMLLSSEDHTGLSHAGTKSILKLAQRMKLNFYSGITASCIHKWEKLLAENVGQDTRILTRKSLEPSGIVLSAATSLWLPVTQQRLFEFLCDGKCRNQWDILSNGASMENTLLVPKGQQEGSCVSLLRAAGNDQNESSMLILQETWNDVSGALVVYAPVDIPSMNTVMSGGDSAYVALLPSGFSILPDGSSSSSDQFDTDGGLVNQESKGCLLTVGFQILVNSLPTAKLNVESVETVNNLIACTIHKIRAALRIPA

SEQ ID NO: 761 - DNA, 2253 bp, Arabidopsis thaliana
  G268,family:AKR
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacacaatatattttgtttggtagtatatctcttattgttttcttcttttttctcttaatgtaactgtaaatttgattgtggtgttttactgagtaaaagtttacctcgtcctcaaaaa

SEQ ID NO: 762 - protein, 694 aa, Arabidopsis thaliana
  G268,AKR domain coordinates 186-689
MKPLTNGDLFKSPTLIKISALVFVTVAFFYLGKHWSDDGYQQLVFFSSSTSGSSIPEVSVSPNSNRVFNLSAIIPTNHTQIEIPATIRQQPPSVVADTEKVKVEANPPPPPPPSPSPPPPPGPVKSFGIVDANGVMSDDFEVGEVESDTVEDWGNQTEIVEAKSDGDSKARVRIKKFGMCPESMREYIPCLDNTDVIKKLKSTERGERFERHCPEKGKGLNCLVPPPKGYRQPIPWPKSRDEVWFSNVPHTRLVEDKGGQNWISRDKNKFKFPGGGTQFIHGADQYLDQMSKMVSDITFGKHIRVAMDVGCGVASFGAYLLSRDVMTMSVAPKDVHENQIQFALERGVPAMAAAFATRRLLYPSQAFDLIHCSRCRINWTRDDGILLLEINRMLRAGGYFAWAAQPVYKHEPALEEQWTEMLNLTISLCWKLVKKEGYVAIWQKPFNNDCYLSREAGTKPPLCDESDDPDNVWYTNLKPCISRIPEKGYGGNVPLWPARLHTPPDRLQTIKFDSYIARKELFKAESKYWNEIIGGYVRALKWKKMKLRNVLDMRAGFGGFAAALNDHKLDCWVLSVVPVSGPNTLPVIYDRGLLGVMHDWCEPFDTYPRTYDFLHASGLFSIERKRCEMSTILLEMDRILRPGGRAYIRDSIDVMDEIQEITKAMGWHTSLRDTSEGPHASYRILTCEKRLLRA

SEQ ID NO: 763 - DNA, 1083 bp, Arabidopsis thaliana
  G2682,family:CPP
atgacaggaaacgcagattccggcaaaatcgcgacagagaaagaccctaggaagctcgttttcaccaaattggaggtatctcccgtcttccgagaatctcctgttaaagaacttcctctttttcctccgatttctcgcagagagcattcagaagcaaaggataagacagatgaagaaggcattacttcgaggaaacacaaaggatgtcgatgcaagcagtccaaatgtttaaagttgtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaactccgttattttcgatacctgacaattccattcaaaatgctctgggttcccctatgtcttgctctcctaaacttccttacaggtccctcatgggatacacctctacacttcttccggacttgggagatttatgctcacttctcgttgcagcgtcagaatctgctacaacaactgcagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataa

SEQ ID NO: 764 - protein, 360 aa, Arabidopsis thaliana
  G2682,CPP domain coordinates 67-181
MTGNADSGKIATEKDPRKLVFTKLEVSPVFRESPVKELPLFPPISRREHSEAKDKTDEEGITSRKHKGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKNVSEAFQPPAFSAHNSPQVYRRRRDRELTEATPLFSIPDNSIQNALGSPMSCSPKLPYRSLMGYTSTLLPDLGDLCSLLVAASESATTTAEDQNRIFTKPDDKEAIELSSESESRNVEEEIQSRGRLIELIDVQYNGEEDSQCKTKTSVNETDIYMEQERAVLETFRDCLQKFIKSRLES

SEQ ID NO: 765 - DNA, 726 bp, Arabidopsis thaliana
  G2686,family:WRKY
atgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagaagatttgcggagtaaaaggtttagagatttacagagatgattcccccaatccccgccttgatgacggcttcacctggaggaaatatggacaaaaaaccatcaaaacctctttgtaccaaaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttga

SEQ ID NO: 766 - protein, 241 aa, Arabidopsis thaliana
  G2686,WRKY domain coordinates 122-173
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 767 - DNA, 438 bp, Arabidopsis thaliana
  G2688,family:WRKY
atggagggatatgataatgggtcgttgtatgctccttttttgtcgttgaaatctcattcgaaaccagagctgcatcaaggcgaagaagagagctcaaaggttagatcagaaggttgttcgaaaagcgtggagtcgtcgaaaaagaaggggaagaaacaaaggtatgcgtttcaaacaaggagccaagtggatattcttgatgatggttatcgatggaggaaatatggccaaaaggccgtcaagaacaacaagttccctaggagttactataggtgtacatatggaggatgcaatgtgaagaagcaagtgcaaagattaacagtggaccaagaagtggtcgtgacaacctacgaaggagtgcattcgcatcccatcgagaaatccaccgaaaacttcgagcatattctcactcaaatgcaaatctactcttctttctag

SEQ ID NO: 768 - protein, 145 aa, Arabidopsis thaliana
  G2688,WRKY domain coordinates 67-124
MEGYDNGSLYAPFLSLKSHSKPELHQGEEESSKVRSEGCSKSVESSKKKGKKQRYAFQTRSQVDILDDGYRWRKYGQKAVKNNKFPRSYYRCTYGGCNVKKQVQRLTVDQEVVVTTYEGVHSHPIEKSTENFEHILTQMQIYSSF

SEQ ID NO: 769 - DNA, 1872 bp, Arabidopsis thaliana
  G2696,family:SCR
atgcccctgccctttgagcaatttcaagggaagggggttctgggtttcttagattcttcttcttctccgggatacaaaatctgggctaatccagagaagctccatggacgagtagaagaagatctctgctttgttgtcaacaatggtggtttctcggagccgacgtctgttttagactctgttagaagtccaagccctttcgtctcttcttcaaccaccacgctgtcttcttctcacggtggtcccagcggcggcggcgctgctgctgctactttttccggcgccgatgggaaatgcgaccaaatgggtttcgaggatctcgatggtgttctctccggtggctcgccgggacaagaacagagtatttttagattaatcatggctggcgatgtagtggatccgggttcggagtttgtgggtttcgacatcggttctggatccgacccggttattgataatcctaatccactctttggatatggcttcccttttcaaaacgcaccggaagaagaaaagtttcagatttcaataaacccaaatccgggtttcttctcggatcctccgtcgtctcctcctgcgaaacggctcaattcgggtcaacccggatctcaacacctccagtgggttttcccgttctcggatccgggtcacgaatctcacgacccgtttctcacaccgccaaagatagccggagaagaccaaaacgaccaagaccagtcagcggtaatcatcgaccagctattctctgcggcggcggagctcaccacaaacggcggagataacaatcccgttctcgcgcaagggatattggcgcggctcaatcacaaccttaacaacaacaacgacgacactaacaacaatcctaaacctccgttccacagagcagcttcgtatataacagaagctcttcactctctccttcaagactcatcattatcaccaccgtctctctcacctcctcaaaacctaatctttcggatcgcagcttacagagctttctcagaaacgtcaccgtttcttcaattcgtcaacttcacagcaaaccaaacgattctcgagtcattcgaagggtttgatcggatccacattgtcgatttcgatatcggttatggaggtcaatgggcgtctctgattcaagagctcgccggaaaaagaaacagatcttcatcagctccgtcgctaaagattacagctttcgcttctccttcaactgtctccgacgaattcgagctccgattcactgaagaaaatctcagaagcttcgccggcgaaacaggtgtctccttcgaaatcgagctcttaaacatggagattctcttgaatccaacttattggccactgtctttattccgatcatcggagaaagaagcaatcgctgtgaatctcccaatcagctccatggtctccggttacctcccattgatacttcgtttcctcaagcaaatctcaccaaacgtcgtcgtttgctcagacagaagctgcgaccgtaacaacgacgcgccgttccctaacggtgtgattaacgcgcttcagtactacacatctctgctcgagtctctcgactctgggaatctgaataatgcggaagctgctacgagtattgagaggttttgtgtgcaaccgtcgatacagaaactgttgacgaatcgttaccgttggatggagagatcaccgccgtggagaagcttatttgggcaatgtgggtttactcctgtgacgctgagtcagacggcggagacacaagcggagtatttgttgcagaggaatccaatgagagggtttcacttggagaagagacagtcttcgtcgccttcacttgtcttgtgttggcagaggaaagaacttgttactgtctcagcttggaaatgttaa

SEQ ID NO: 770 - protein, 623 aa, Arabidopsis thaliana
  G2696,SCR domain coordinates 330-398,545-621
MPLPFEQFQGKGVLGFLDSSSSPGYKIWANPEKLHGRVEEDLCFVVNNGGFSEPTSVLDSVRSPSPFVSSSTTTLSSSHGGPSGGGAAAATFSGADGKCDQMGFEDLDGVLSGGSPGQEQSIFRLIMAGDVVDPGSEFVGFDIGSGSDPVIDNPNPLFGYGFPFQNAPEEEKFQISINPNPGFFSDPPSSPPAKRLNSGQPGSQHLQWVFPFSDPGHESHDPFLTPPKIAGEDQNDQDQSAVIIDQLFSAAAELTTNGGDNNPVLAQGILARLNHNLNNNNDDTNNNPKPPFHRAASYITEALHSLLQDSSLSPPSLSPPQNLIFRIAAYRAFSETSPFLQFVNFTANQTILESFEGFDRIHIVDFDIGYGGQWASLIQELAGKRNRSSSAPSLKITAFASPSTVSDEFELRFTEENLRSFAGETGVSFEIELLNMEILLNPTYWPLSLFRSSEKEAIAVNLPISSMVSGYLPLILRFLKQISPNVVVCSDRSCDRNNDAPFPNGVINALQYYTSLLESLDSGNLNNAEAATSIERFCVQPSIQKLLTNRYRWMERSPPWRSLFGQCGFTPVTLSQTAETQAEYLLQRNPMRGFHLEKRQSSSPSLVLCWQRKELVTVSAWKC

SEQ ID NO: 771 - DNA, 1581 bp, Arabidopsis thaliana
  G2697,family:SCR
atggaagctactcagaaacatatgattcaagaaggatcttcaatgttttaccatcaaccatcttcagtcaaacaaatggacctttctgttcagacatttgattcttactgcacacttgaatcctcttcaggcaccaagtctcatccttgtcttaacaacaaaaacaactcttcttcaaccacaagcttttcctctaatgaaagtcccatttctcaagccaacaacaacaacttatcaaggtttaacaatcattcccctgaagaaaacaataactctcccttgagcggttcttcagcgacaaacaccaacgagacagagcttagtctcatgcttaaagatttggagactgcaatgatggagcctgatgtagacaacagctataacaatcaaggcgggtttggacagcagcatggagttgtttcttcagctatgtatagatctatggagatgatctctaggggagatttaaaaggagtgctctatgaatgcgcaaaagctgttgaaaactatgatttggaaatgactgattggttgatctctcagttacagcaaatggtttctgtttctggtgagcctgttcagcgcttaggagcttatatgcttgaaggtctcgttgctaggttagcttcttcgggtagctccatctataaagcattgagatgcaaagacccaacgggtcctgagcttcttacttatatgcatatcttgtatgaagcctgcccttatttcaaattcggttatgaatctgctaatggagctatagctgaagctgtgaagaacgaaagttttgtgcacattatcgatttccagatttctcaaggtggtcaatgggtgagtttgatccgtgctcttggtgctagacctggtggacctccgaacgttaggataacgggaattgatgatccgagatcatcgtttgctcgtcaaggaggacttgagttagttggacaaagacttgggaagctagctgaaatgtgcggtgttccgtttgagttccatggagctgctttatgctgcacggaagtcgaaatcgagaagctaggagttagaaatggagaagcgctcgcggttaacttcccgcttgttcttcaccacatgcctgatgagagtgtaactgtggagaatcacagagatagattgttgagattggtcaaacacttgtcaccaaacgttgtgactctggttgagcaagaagcgaatacaaacactgcgccgtttcttccccggtttgtcgagacaatgaaccattacttggcagttttcgaatcaatagatgtgaaactcgctagagatcacaaggaaaggatcaatgttgagcagcattgtttggctagagaggttgtgaatcttatagcttgtgaaggtgttgaaagagaagagaggcacgagccactagggaaatggaggtctcggtttcacatggcgggatttaaaccgtatcctttgagctcgtatgtgaacgcaacaatcaaaggattgcttgagagttattcagagaagtatacacttgaagaaagagatggagcattgtatttaggatggaagaatcaacctcttatcacttcttgtgcttggaggtaa

SEQ ID NO: 772 - protein, 526 aa, Arabidopsis thaliana
  G2697,SCR domain coordinates 233-298,361-449,453-525
MEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 773 - DNA, 1233 bp, Arabidopsis thaliana
  G2699,family:SCR
atgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaa

SEQ ID NO: 774 - protein, 410 aa, Arabidopsis thaliana
  G2699,SCR domain coordinates 107-172,243-333,333-407
MTKTRILNPTRFPSPKPLRGCGDANFMEQLLLHCATAIDSNDAALTHQILWVLNNIAPPDGDSTQRLTSAFLRALLSRAVSKTPTLSSTISFLPQADELHRFSVVELAAFVDLTPWHRFGFIAANAAILTAVEGYSTVHIVDLSLTHCMQIPTLIDAMASRLNKPPPLLKLTVVSSSDHFPPFINISYEELGSKLVNFATTRNITMEFTIVPSTYSDGFSSLLQQLRIYPSSFNEALVVNCHMMLRYIPEEPLTSSSSSLRTVFLKQLRSLNPRIVTLIEEDVDLTSENLVNRLKSAFNYFWIPFDTTDTFMSEQRRWYEAEISWKIENVVAKEGAERVERTETKRRWIERMREAEFGGVRVKEDAVADVKAMLEEHAVGWGMKKEDDDESLVLTWKGHSVVFATVWVPI

SEQ ID NO: 775 - DNA, 1080 bp, Arabidopsis thaliana
  G2704,family:MYB-(R1)R2R3
atgtatcaccaaaatctgatttcatcgaccccaaaccaaaattctaatcctcacgattgggatattcaaaatcctttattttccatacatccttcagctgaaataccctcaaaatatccctttatgggtatcacttcttgcccaaacaccaatgtttttgaggaatttcaatataaaataaccaacgatcaaaactttccaacgacctataacaccccattccctgtaatatctgaaggtatatcatacaatatgcatgatgttcaagagaatactatgtgtggttatactgctcacaatcaagggcttatcattggttgtcacgagccagttcttgttcatgccgtggttgagtctcagcaatttaatgtcccacagtcagaggatatcaatttagtatctcagagtgagagggtcacagaagataaggtaatgttcaaaaccgatcataagaagaaagacattattggcaaagggcaatggactcctactgaagacgagttgttggtgagaatggtgaaaagtaaaggaacgaaaaactggacatcaatcgcaaaaatgttccaaggacgagtaggaaaacaatgtcgagagaggtggcataaccatcttcgaccaaacatcaagaaaaatgattggagtgaagaagaagatcaaatacttattgaagtccacaagatagttggcaacaaatggaccgaaattgctaaaagacttcctggacgaagtgaaaatattgttaaaaatcattggaatgctacaaaacgtcgactacactccgtaaggactaagagaagtgatgctttttcccctcgcaacaatgcccttgaaaattacataaggtctatcacaatcaacaacaatgcccttatgaacagagaagttgattctataactgcaaactcggaaattgatagtaccagatgtgagaatattgttgacgaggtgatgaatctgaatctgcacgctacaacgtccgtttatgttccggagcaagcagtgttgacatggggttatgattttacaaaatgttatgaacccatggatgatacatggatgctcatgaatggttggaattaa

SEQ ID NO: 776 - protein, 359 aa, Arabidopsis thaliana
  G2704,MYB-(R1)R2R3 domain coordinates 158-258
MYHQNLISSTPNQNSNPHDWDIQNPLFSIHPSAEIPSKYPFMGITSCPNTNVFEEFQYKITNDQNFPTTYNTPFPVISEGISYNMHDVQENTMCGYTAHNQGLIIGCHEPVLVHAVVESQQFNVPQSEDINLVSQSERVTEDKVMFKTDHKKKDIIGKGQWTPTEDELLVRMVKSKGTKNWTSIAKMFQGRVGKQCRERWHNHLRPNIKKNDWSEEEDQILIEVHKIVGNKWTEIAKRLPGRSENIVKNHWNATKRRLHSVRTKRSDAFSPRNNALENYIRSITINNNALMNREVDSITANSEIDSTRCENIVDEVMNLNLHATTSVYVPEQAVLTWGYDFTKCYEPMDDTWMLMNGWN

SEQ ID NO: 777 - DNA, 605 bp, Arabidopsis thaliana
  G2710,family:HB
atctatctcttgccttagcctaagcacttctatctatctccttcttctttatcatcatccaaatgtcatctagctcaaacaagaattctaataaggatcatgatgatcatcataatgatcaaggccaacacaataccatccatactccgtctttcatgcacacctttgaaataagtaacatttcttctccatcttctccagtcgtatcggatcctaaaccagaatggaaaccaaatcaacatcaagctcaaatactcgaagaacttttcatcggcggtacggttaacccgtctctaaccagtatcaaacaaatcacgatcaaacttcaaagttatggtgaagaagtcgacgacgcagacgtctacaagtggtttcacaaccgaaaatatagtcgcaaaccgaaatcctgatctagaaatgttgaagatatacagtgggttaaaaccaaaatatataaagaggagtttgttataaacgctttatatttctatttattaagaattatgatagagaaaattactgtgataagttgtcatacttctataaatgtattttctgaaaaatattaattataattattcaaaatatagcatgaaaaaaaaaaa

SEQ ID NO: 778 - protein, 115 aa, Arabidopsis thaliana
  G2710,HB domain coordinates 55-115
MSSSSNKNSNKDHDDHHNDQGQHNTIHTPSFMHTFEISNISSPSSPVVSDPKPEWKPNQHQAQILEELFIGGTVNPSLTSIKQITIKLQSYGEEVDDADVYKWFHNRKYSRKPKS

SEQ ID NO: 779 - DNA, 621 bp, Arabidopsis thaliana
  G2712,family:HB
atggccctctcacctaattcaagctctttagatttaacaatctcaattccgagcttctctccatctccttcacttggtgatcatcacgggatgagagattttgacataaaccaaacaccaaagacggaagaagatcgtgagtggatgatcggtgcaacaccacatgtcaacgaagatgatagcaactcgggtggccggcggcgcaaaaagctccgtctaacgaaagaacaatcacatcttcttgaagagagtttcatacaaaaccataccttaacccctaagcaaaaaaaagatttggccacctttttgaagcttagtcaaaggcaagttgaggtgtggtttcaaaatcgaagagctcggagtaagctaaagcacacggaaatggaatgtgagtatctaaaaagatggttcggatcgttgaaggaacaaaatcgacggctacaaatagaagttgaagaactacgagcgctaaagccatcatcgacctcggctttaaccatgtgtcctcggtgtgaacgtgtgactgatgcagtagataatgactctaatgccgttcaagagggggcagttcttagcagccggtcacggatgacaatttcctcttcctcttccctctgttga

SEQ ID NO: 780 - protein, 206 aa, Arabidopsis thaliana
  G2712,HB domain coordinates 65-125
MALSPNSSSLDLTISIPSFSPSPSLGDHHGMRDFDINQTPKTEEDREWMIGATPHVNEDDSNSGGRRRKKLRLTKEQSHLLEESFIQNHTLTPKQKKDLATFLKLSQRQVEVWFQNRRARSKLKHTEMECEYLKRWFGSLKEQNRRLQIEVEELRALKPSSTSALTMCPRCERVTDAVDNDSNAVQEGAVLSSRSRMTISSSSSLC

SEQ ID NO: 781 - DNA, 1311 bp, Arabidopsis thaliana
  G2715,family:MYB-(R1)R2R3
atggaagatacgaagaagaaaaagaagaagaatattaacaacaaccaagattccaagaaaaaagagcgtcatattgttacttggtcacaagaggaagatgttatactaagagaacaaataactctacatggaactgaaaattgggcgatcattgcatcaaagttcaaagacaaaagcacaagacaatgcagaagaagatggtatacatacttaaactctgatttcaaaagaggaggttggtcccctgaagaagatatgcttttgtgtgaggcacaaagagtatttggtaatagatggactgagatagcaaaggtggtttcaggcagaactgataatgctgtgaagaacaggtttacaacactttgtaagaagagagccaagcatgaagctatgactaaagacagcaactcaaacaccaaaagaatgttgttcttagacggtatcagtacaccgcgaaaatccgagaatgaaactcctattgctaagaaattgaagagaagtcacattctagatctcacagagatcagtaactatggaagggccgaggcatgtgtgaatcagcagataaggtctccattttcggttttagctcgaaatgccactggtattgatagcttggaagaacagaatcaaacaagcaatgtgaatgagagtgatggtgaagggatgtttcttaagaaggatgatccaaaagtgacagctttgatgcaacaagctgaacttttaagctccttggcgcagaaagttaatgcagacaacacagaacagagtatggagaatgcttggaaggttcttcaggacttcttgaataaaggcaaggagaatgatttattcagatatggaatacctgatatagattttaagatcgaggaatttaaggaccttatagaggatttgaggagtggttatgaagacaatcaattatcttggaggcaacctgatcttcatgactcaccagctagctctgagtatagttccggatcaaccatcatggtggatcagtctggtgataaaacacaaccattctcagcagatactcagacagaacataagcaagttggagaggagttgctcgtcccgaaaaatcctgatgagaatatgcccatctcaggcgaagaaaagttcagctcgcctattcaggtcacgccattgttcagatctttggcagacggtataccaagtccacagttctccgaaagtgagaggagcttcctgctaaaaacactagggatcgagtcctcatctccatgtccaagtgctaatccttcaaaaccacccccttgcaaaagagtccttctccatagcttgtaa

SEQ ID NO: 782 - protein, 436 aa, Arabidopsis thaliana
  G2715,MYB-(R1)R2R3 domain coordinates 25-110
MEDTKKKKKKNINNNQDSKKKERHIVTWSQEEDVILREQITLHGTENWAIIASKFKDKSTRQCRRRWYTYLNSDFKRGGWSPEEDMLLCEAQRVFGNRWTEIAKVVSGRTDNAVKNRFTTLCKKRAKHEAMTKDSNSNTKRMLFLDGISTPRKSENETPIAKKLKRSHILDLTEISNYGRAEACVNQQIRSPFSVLARNATGIDSLEEQNQTSNVNESDGEGMFLKKDDPKVTALMQQAELLSSLAQKVNADNTEQSMENAWKVLQDFLNKGKENDLFRYGIPDIDFKIEEFKDLIEDLRSGYEDNQLSWRQPDLHDSPASSEYSSGSTIMVDQSGDKTQPFSADTQTEHKQVGEELLVPKNPDENMPISGEEKFSSPIQVTPLFRSLADGIPSPQFSESERSFLLKTLGIESSSPCPSANPSKPPPCKRVLLHSL

SEQ ID NO: 783 - DNA, 1200 bp, Arabidopsis thaliana
  G2719,family:MYB-(R1)R2R3
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 784 - protein, 399 aa, Arabidopsis thaliana
  G2719,MYB-(R1)R2R3 domain coordinates 56-154
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 785 - DNA, 894 bp, Arabidopsis thaliana
  G2720,family:MYB-(R1)R2R3
atggaagcgaagaaggaagagataaagaaaggtccatggaaagccgaagaagacgaagtactcatcaaccatgtcaagagatacggtcctcgtgattggagctccattcgatccaaaggtcttcttcaacgcaccggcaaatcctgtcgtcttcgttgggtcaataaactccgtcccaatctcaaaaatggatgcaagttctcggctgacgaagagaggactgtgattgagttacaatctgagtttggtaacaaatgggcgagaatcgctacgtatctaccgggaagaactgataacgatgtgaagaatttctggagtagcagacaaaagagactcgctaggattcttcataactcctctgatgcatcgagttcgagtttcaatcccaaatcttcttcttctcatcgactcaagggcaaaaacgtcaaaccaatccgtcaatcctctcagggttttggtttggttgaggaagaggttacagtttcttcttcatgttcccagatggttccttattcatctgatcaagttggtgatgaagtcttgaggttgccggatttgggtgttaagttagagcatcagcctttcgcttttggcactgatcttgtcctagcagagtactctgactcacagaatgatgcaaatcagcaagcaatcagccctttctctccagaaagcagagagcttttggctagacttgacgaccctttttactatgatatacttggaccagctgattcttctgagccattgttcgctctccctcagccgttcttcgagccttcgcctgtgccgagaagatgcagacatgtttcaaaggatgaagaagctgatgttttcttagacgatttcccagctgacatgtttgatcaggttgatccaatcccaagtccttag

SEQ ID NO: 786 - protein, 297 aa, Arabidopsis thaliana
  G2720,MYB-(R1)R2R3 domain coordinates 10-114
MEAKKEEIKKGPWKAEEDEVLINHVKRYGPRDWSSIRSKGLLQRTGKSCRLRWVNKLRPNLKNGCKFSADEERTVIELQSEFGNKWARIATYLPGRTDNDVKNFWSSRQKRLARILHNSSDASSSSFNPKSSSSHRLKGKNVKPIRQSSQGFGLVEEEVTVSSSCSQMVPYSSDQVGDEVLRLPDLGVKLEHQPFAFGTDLVLAEYSDSQNDANQQAISPFSPESRELLARLDDPFYYDILGPADSSEPLFALPQPFFEPSPVPRRCRHVSKDEEADVFLDDFPADMFDQVDPIPSP

SEQ ID NO: 787 - DNA, 294 bp, Arabidopsis thaliana
  G2721,family:MYB-related
atggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggaaaatgaagaatttgaagatctaa

SEQ ID NO: 788 - protein, 97 aa, Arabidopsis thaliana
  G2721,MYB-related domain coordinates 10-60
MASNSRSSISPWTFSQNKMFERALAVYDKDTPDRWHNVAKAVGGKTVEEVKRHYDILVEDLINIETGRVPLPNYKTFESNSRSINDFDTRKMKNLKI

SEQ ID NO: 789 - DNA, 279 bp, Arabidopsis thaliana
  G2723,family:MYB-related
atggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtga

SEQ ID NO: 790 - protein, 92 aa, Arabidopsis thaliana
  G2723,MYB-related domain coordinates 10-60
MASSSMSSSSSWTSKQNKMFERALAVYDKDTPDRWQNVAKAVGSKSAEEVKRHYDILVEDLMNIEQDLVPLPKYKTVDVGSKSRGIDDFDLR

SEQ ID NO: 791 - DNA, 651 bp, Arabidopsis thaliana
  G2724,family:MYB-(R1)R2R3
atggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtag

SEQ ID NO: 792 - protein, 216 aa, Arabidopsis thaliana
  G2724,MYB-(R1)R2R3 domain coordinates 7-113
MEIEIRRGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLKCDVNSKQFKDTIKHLWMPRLIERIAATQSVQFTSNHYSPENSSVATATSSTSSSEAVRSSFYGGDQVEFGTLDHMTNGGYWFNGGDTFETLCSFDELNKWLIQ

SEQ ID NO: 793 - DNA, 2269 bp, Arabidopsis thaliana
  G273,family:AKR
ttccttccttacttgtggagatggagatctgaatctctaaagtttcgatttttatttattcacttttatgcccaaaaagaaaaatcgttactttaaagccaaaaagaagaatacacaaacttcattcactctctcccattctcggatctctctcagtgcacagtggttgtcactcttctcctttggtcgaaactctttcttggaaagagcattttgttatcaagactctgaagagctcttttgggaggatagtaaggttggatgatgagagggagatctgatggaggcctaaagaagcggcttattgcttcggtctgtgtcgtggctctattcgtctgtttcttgtttatgtactatggttcctctagccaaggtgcatcagcattggaatatggaagatctttgagaaaactcggatcgtcttatttgagtggagatgatgataatggtgataccaaacaggatgattctgtggctaatgcagaagacagtcttgttgtcgccaaaagttttcctgtttgtgatgaccggcactcggaaatcatcccttgcttagataggaatttcatctaccaaatgaggttgaagcttgatctctctttaatggaacattatgaacggcattgtcctcctcccgaaagacggtttaattgtttgattcctccaccatctggatacaaggttcctattaagtggcctaagagtagagatgaagtgtggaaagcaaacatacctcacactcaccttgcaaaagagaagtctgatcagaactggatggttgagaaaggcgagaaaatttcttttcccggtggaggcactcatttccattacggtgctgataaatacattgcatcgatcgcaaatatgcttaacttttcgaacgatgtattgaatgacgaagggagattaagaacggttcttgatgtcggatgcggagttgcgagttttggagcttaccttctcgcgtctgatataatgacaatgtcactagcccctaatgatgttcatcagaaccaaatccagtttgcgttagaaagaggaatccctgcttatcttggtgttttaggtaccaaaaggcttccttacccgagcagatcattcgagtttgctcattgttctcgatgtaggattgattggcttcaaagagacggacttcttcttcttgagctcgatcgggtactaagaccgggaggttatttcgcgtattcgtctcctgaagcttacgcacaagatgaagagaatttgaaaatctggaaggagatgagtgctcttgttgaaagaatgtgttggagaattgccgttaaaagaaaccaaactgtggtttggcagaaaccgttgagtaatgactgttacttggagagagagcccgggacacagcctcctctctgtcgctcagatgctgatcctgatgcggttgcgggtgtttcaatggaagcttgcatcactccttactccaagcatgaccataaaaccaagggaagtgggttagctccttggccagctaggttgacttcttctcctccccgtcttgcggatttcggttattcaaccgacatgtttgagaaggacacggaactttggaaacaacaagtggacagttactggaatctgatgtcatcgaaagtcaaatcaaacactgtgaggaacataatggacatgaaagctcacatgggttctttcgcagctgctcttaaagacaaagatgtgtgggtgatgaacgttgtctctcccgacggtcccaacactctaaaactgatctacgaccgtggtttaatcggaacaaatcataactggtgtgaggctttctctacatatcctcgaacatacgatctgttgcacgcgtggtctatattttcagacattaaaagcaaaggatgcagtgcagaggatctactaatcgagatggatcggattcttagacctacgggattcgttatcatcagagataagcagagtgttgttgagtcaatcaagaagtatttgcaggctttgcattgggagactgtggcatcagagaaggtaaatacaagttcagaactcgaccaagacagtgaagatggtgagaacaatgtcgttttcattgtccagaagaaactttggctcaccagtgaaagccttagggacagcgagtaaaaaacatatcaaaagcaaagagagagaaattgttttatcccacaaagtttttatatagttttattttgatttttgtagttgatttgtacgacataaagcattattatataaaatactaaaattattcattgttaaa

SEQ ID NO: 794 - protein, 623 aa, Arabidopsis thaliana
  G273,AKR domain coordinates 93-610
MMRGRSDGGLKKRLIASVCVVALFVCFLFMYYGSSSQGASALEYGRSLRKLGSSYLSGDDDNGDTKQDDSVANAEDSLVVAKSFPVCDDRHSEIIPCLDRNFIYQMRLKLDLSLMEHYERHCPPPERRFNCLIPPPSGYKVPIKWPKSRDEVWKANIPHTHLAKEKSDQNWMVEKGEKISFPGGGTHFHYGADKYIASIANMLNFSNDVLNDEGRLRTVLDVGCGVASFGAYLLASDIMTMSLAPNDVHQNQIQFALERGIPAYLGVLGTKRLPYPSRSFEFAHCSRCRIDWLQRDGLLLLELDRVLRPGGYFAYSSPEAYAQDEENLKIWKEMSALVERMCWRIAVKRNQTVVWQKPLSNDCYLEREPGTQPPLCRSDADPDAVAGVSMEACITPYSKHDHKTKGSGLAPWPARLTSSPPRLADFGYSTDMFEKDTELWKQQVDSYWNLMSSKVKSNTVRNIMDMKAHMGSFAAALKDKDVWVMNVVSPDGPNTLKLIYDRGLIGTNHNWCEAFSTYPRTYDLLHAWSIFSDIKSKGCSAEDLLIEMDRILRPTGFVIIRDKQSVVESIKKYLQALHWETVASEKVNTSSELDQDSEDGENNVVFIVQKKLWLTSESLRDSE

SEQ ID NO: 795 - DNA, 1629 bp, Arabidopsis thaliana
  G2739,family:SCR
atggcgtatatgtgcaccgacagcggaaacttaatggctatagcacaacaactcatcaaacagaagcagcaacaacaatcacaacatcaacaacaagaagaacaagaacaagaacccaacccctggcccaatccatccttcgggtttactcttcccggttcgggtttctccgacccgtttcaagtaaccaacgacccaggttttcactttccacacctggagcatcatcaaaacgcagccgtcgcttccgaggagtttgactccgacgagtggatggagagtttgatcaacggtggagatgcgtcacaaaccaatccagacttcccaatctacggccatgatccattcgtctcattcccgagtcgactcagtgctccttcatatctcaaccgagtcaacaaagatgactcagcgagtcaacaactccctccgccaccagcttccaccgctatatggtctccatctccgccatcaccacaacatcctcctcctcccccgccgcagccggattttgatctaaaccagccgatttttaaagctatccacgattatgcacgtaaaccggaaactaaaccggacacactaattcggatcaaagaatccgtgtccgaatcaggcgacccgatacaacgagtcgggtattacttcgcagaagctctgtctcataaagaaacagagtctccgtcgtcatcgtcgtcgtcatccctagaagatttcattctctcatacaaaaccttaaacgacgcatgtccatattcaaagttcgctcatttaacagcgaatcaagcaattctcgaagctacgaatcaatcaaacaacattcacatagtcgatttcgggatttttcaaggtattcaatggtctgctctgttacaagctttagcgacccgttcttctggtaaacccacccggatccggatttcgggtatacccgctccgtctctaggagactcaccgggaccgtctctgatcgctacgggaaaccgtctccgtgatttcgcggcgattttggatctcaatttcgagttttatccggttctgactccgattcaattactaaacgggtcaagttttcgggttgacccggatgaggttttggttgtgaattttatgcttgagctttataagcttctagatgaaacagcgacgactgttggtacggcgctccggttagctagatcgttaaacccgaggattgtgacgcttggagaatacgaagtcagtttaaaccgggttgaatttgctaaccgggttaagaactctctccggttttattccgcggtttttgaatcgcttgaaccgaatttggatcgagattcgaaagaaaggctgagagtggagagagtgttgttcggtaggaggattatggatttggtccgatcagatgatgataataataaaccgggaacccggtttgggttaatggaggagaaagaacaatggagagtgttgatggagaaagctggatttgagccggttaaaccgagtaattacgcggttagccaagcgaagctgctactatggaactacaattatagtacattgtattcacttgttgaatcggagccaggtttcatctccttggcttggaacaatgtgcctctcctcaccgtttcctcttggcgttga

SEQ ID NO: 796 - protein, 542 aa, Arabidopsis thaliana
  G2739,SCR domain coordinates 243-309,368-457,466-541
MAYMCTDSGNLMAIAQQLIKQKQQQQSQHQQQEEQEQEPNPWPNPSFGFTLPGSGFSDPFQVTNDPGFHFPHLEHHQNAAVASEEFDSDEWMESLINGGDASQTNPDFPIYGHDPFVSFPSRLSAPSYLNRVNKDDSASQQLPPPPASTAIWSPSPPSPQHPPPPPPQPDFDLNQPIFKAIHDYARKPETKPDTLIRIKESVSESGDPIQRVGYYFAEALSHKETESPSSSSSSSLEDFILSYKTLNDACPYSKFAHLTANQAILEATNQSNNIHIVDFGIFQGIQWSALLQALATRSSGKPTRIRISGIPAPSLGDSPGPSLIATGNRLRDFAAILDLNFEFYPVLTPIQLLNGSSFRVDPDEVLVVNFMLELYKLLDETATTVGTALRLARSLNPRIVTLGEYEVSLNRVEFANRVKNSLRFYSAVFESLEPNLDRDSKERLRVERVLFGRRIMDLVRSDDDNNKPGTRFGLMEEKEQWRVLMEKAGFEPVKPSNYAVSQAKLLLWNYNYSTLYSLVESEPGFISLAWNNVPLLTVSSWR

SEQ ID NO: 797 - DNA, 2330 bp, Arabidopsis thaliana
  G274,family:AKR
agctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 798 - protein, 621 aa, Arabidopsis thaliana
  G274,AKR domain coordinates 94-600
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 799 - DNA, 943 bp, Arabidopsis thaliana
  G2742,family:GARP
aaaaaaaaaaacgttttctttttctttcaagaaatcaagatcaaaagaattagggttttcgaatgggtaggtgtggaagaagcaacgacggagtaattggtggagtaagaccatacgtacgatctccggtgcctcgtctgagatggacgccggagcttcaccggagtttcgttcacgccgttgatttgctcggcggtcaatataaagcaactccaaaacttgttctgaagataatggatgtcaagggactaaccatatcacacgtcaagagccatctccagatgtataggggatccagaatcactcttcttggaaaaccagaagagagttcttcaccatcttcaagaagaagaagaagacaagacaatgaagaagatcatcttcatgacaacttgtctgtacacgcaaggaatgattgtcttttgggttttcactcttttaactttagagagcagacttcagcgactgataatgatgacgatgactttcttaacatcatgaacatggagagaacgaagacatttgcaggcaatggcgagtccatcaaatttcagtctcatcactctctcgaggctgagaacacgaagaacatttggaaaaacacatggcgagaaaacgaacacgaagaagaagaagagttatcgctgtctctgtcgttgaatcatcctcataaccatcaacaaagatggaaaagcaatgcttcatcatcactcagtgaaacaagcgaagcagtctcatcttcttctggtccattcatcttcagagattgttttgcttcttcgaagattgatcttaatcttaatctctccttttctctactccatagctgaagctttgttcagctttgttcctttgttctaaattttagcgtagtgaacatttagattgtttttaaaccaccttaaaagttcctaatcttttagttaggcctcttgatttgtga

SEQ ID NO: 800 - protein, 255 aa, Arabidopsis thaliana
  G2742,GARP domain coordinates 28-76
MGRCGRSNDGVIGGVRPYVRSPVPRLRWTPELHRSFVHAVDLLGGQYKATPKLVLKIMDVKGLTISHVKSHLQMYRGSRITLLGKPEESSSPSSRRRRRQDNEEDHLHDNLSVHARNDCLLGFHSFNFREQTSATDNDDDDFLNIMNMERTKTFAGNGESIKFQSHHSLEAENTKNIWKNTWRENEHEEEEELSLSLSLNHPHNHQQRWKSNASSSLSETSEAVSSSSGPFIFRDCFASSKIDLNLNLSFSLLHS

SEQ ID NO: 801 - DNA, 970 bp, Arabidopsis thaliana
  G2747,family:ABI3/VP-1
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatt

SEQ ID NO: 802 - protein, 299 aa, Arabidopsis thaliana
  G2747,ABI3/VP-1 domain coordinates 19-113
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVMMQRRAQVASMASRGEKRLRLFGVDMECGGGGGSVNSTEEESSSSGGSIPRGRVSMVGAGSLLQLRLVSSDDESLVAMEAASLEDHHFFTKKGKPSLSFDLDR

SEQ ID NO: 803 - DNA, 1015 bp, Arabidopsis thaliana
  G2748,family:TEO
tgagagtagcgttacaatggaggttgacgaagacattgagttacaaaaacatcaagaacaacaaagcagaaagctacaaagattctcagaggacaacactggactaatgaggaattggaacaatccatcgtctcgtatcattagggtttcacgagcttctggtggcaaagatagacatagcaaagtgttaacatcaaaaggtttaagagatcgaagaatacgtctctcagttgctacagcaatccagttctatgatcttcaagatcgtcttggatttgatcagccaagtaaagctgttgaatggttaatcaatgcagcttctgattcaatcactgatcttcctttgcttaacacaaattttgatcatcttgatcagaatcagaatcagaccaaatctgcttgtagtagtggaacatctgagagttcgctgttgtcgttatcaagaacagagattcgtgggaaagcaagagagagagctagagaaagaacagctaaagacagagataaagatttgcagaatgctcatagctcattcactcagcttctcactggtggttttgaccaacaaccgagtaaccggaattggaccggtggttctgattgctttaacccggttcagctgcaaataccaaactcttcctctcaagagccaatgaatcacccattctcctttgtacctgattacaactttggaatctcttcttcttcttctgccattaatggtggttacagtagtagggggacccttcagtccaattcacaatctctctttctgaataacaacaacaacattactcaaaggtcatcgatttcttcgtcttcttcttcctcttctccaatggatagtcaaagcatttcctttttcatggctacacctccacctcttgaccaccataaccaccagcttccggagacttttgatggtcggctatatctttattacggcgaaggaaaccggagctctgatgacaaggcaaaggaaaggagatagtaaaaacaaaatgcttcctttcat

SEQ ID NO: 804 - protein, 324 aa, Arabidopsis thaliana
  G2748,TEO domain coordinates 51-108
MEVDEDIELQKHQEQQSRKLQRFSEDNTGLMRNWNNPSSRIIRVSRASGGKDRHSKVLTSKGLRDRRIRLSVATAIQFYDLQDRLGFDQPSKAVEWLINAASDSITDLPLLNTNFDHLDQNQNQTKSACSSGTSESSLLSLSRTEIRGKARERARERTAKDRDKDLQNAHSSFTQLLTGGFDQQPSNRNWTGGSDCFNPVQLQIPNSSSQEPMNHPFSFVPDYNFGISSSSSAINGGYSSRGTLQSNSQSLFLNNNNNITQRSSISSSSSSSSPMDSQSISFFMATPPPLDHHNHQLPETFDGRLYLYYGEGNRSSDDKAKERR

SEQ ID NO: 805 - DNA, 2231 bp, Arabidopsis thaliana
  G2750,family:AKR
gcagatctctgttgttcagttgcgttaaaagtggtttctttaagattttaaaaatgatggagagaaaacgagaaatggggattgcttatttcgcgcgtaggattaaacagccacgagggatttgggtgaagatgacgttcatagttgttttgggtctctgcttcgtcttcttctggtccttcttatcttcctctgcttctacctttaatgtccagagagaaagcttcgacgacatagctgagccagtgtcatctcgcactaagtcagctcatgaggtgtctgaatctagcaaattacatgagagaggtaaagttgaatctggttcgaaatctaaagaggggaaaaaagttggaggttcgtctgttcataaacatgaaaccaagaaaaagaaagagcatgctgtgtctcatccacataagaagaaggatgtgccaaagcctgtggttgaagaagttgtggttaaggaggatcaagaacatgaagaggcggaatctgacgattctgatcagtctaataaggaagatggagaagaaggaactgagtcagatggcaatgaaggagaatctgatggaaatggagatggaagtgtggatgattcaagtgcatcagttgatgaagaagtggaagaaaagaatgaggaagtaactgtaaacgagataagtaaaaagaggaagaggaaaggtccggtgtttgatcctaaagctgagtatagctggagattgtgtaacactaggagcaagcacaattacatgccatgtattgataatgatgggttaatagggaggcttcagagttatagacatagagagaggagttgtcctaagaaaccagttatgtgtcttgttcctcttccacatgatggctatgatcctcctgtttcctggcctgaaagcaaatctaagatattgtataagaacgtggcacatccgaagttggctgcgtatattaagaagcataattgggtgaatgaaaccggtgaatacctatcttttccacagaaccagactacgttcaacggaaatgttctacagtaccttgaattcattcaagagatggtaccagatattgaatgggggaagaatgttcgtatagtgttggacattggatgctcagattcaagttttgtagctgcattgctggataaggatgttttgacggtgtctctaggtttaaaggacgatctagtcgacttagcacaggtcgctcttgagcgcgggtttcctacttttgtcagctctttagcaagtagaagacttccttttcctagtggagtcttcgataccattcattgtgctgcttgcggagtccactggcattctcatggtggtaaacttctcctggagatgaacagaatattaaggcctaatggatatttcattttgtcaagtaataatgacaagattgaggatgatgaagcgatgactgcattgacagcttctatttgttggaacattcttgcacacaagaccgaagaagcaagtgaaatgggagtgaggatatatcagaaaccagaatcaaatgatatttatgaactgagaaggaagaaaaatccacctctttgcgaggacaacgaaaacccagatgcagcctggtatgtgccgatgaaaacttgtatatatgaaataccgtcggctatagaacaacatggagcagagtggcctgaagaatggccaaagcgacttgaaacataccctgagtggttaaccagcaaagagaaagctatggaagatacaaatcattggaatgctatggtaaacaaatcttacctcactggattaggcatcgactggttacatatccggaatgtgatggacatgacagctatctatggcggatttggggcatcacttgtgaagcagaatgtgtgggtaatgaatgtagtgcctgtgcattcaccagacacacttccattcatatacgaaagaggcctccttggtatataccatgattggtgtgaaccatttggaacatatccaagatcttatgaccttcttcatgctgatcatctcttttcgcggctcaaaaacaggtgtaagcagccggcttcgatcgtggtggagatggatagattgacaaggcctggaggttgggtggttgtgcgtgacaaagtggagatattagagccattggaagagatattaagaagcttgcattgggagattcgaatgacttatgctcaagacaaagaaggaatgttatgtgcccaaaagactttgtggcgtccatgattc

SEQ ID NO: 806 - protein, 724 aa, Arabidopsis thaliana
  G2750,AKR domain coordinates 231-719
MMERKREMGIAYFARRIKQPRGIWVKMTFIVVLGLCFVFFWSFLSSSASTFNVQRESFDDIAEPVSSRTKSAHEVSESSKLHERGKVESGSKSKEGKKVGGSSVHKHETKKKKEHAVSHPHKKKDVPKPVVEEVVVKEDQEHEEAESDDSDQSNKEDGEEGTESDGNEGESDGNGDGSVDDSSASVDEEVEEKNEEVTVNEISKKRKRKGPVFDPKAEYSWRLCNTRSKHNYMPCIDNDGLIGRLQSYRHRERSCPKKPVMCLVPLPHDGYDPPVSWPESKSKILYKNVAHPKLAAYIKKHNWVNETGEYLSFPQNQTTFNGNVLQYLEFIQEMVPDIEWGKNVRIVLDIGCSDSSFVAALLDKDVLTVSLGLKDDLVDLAQVALERGFPTFVSSLASRRLPFPSGVFDTIHCAACGVHWHSHGGKLLLEMNRILRPNGYFILSSNNDKIEDDEAMTALTASICWNILAHKTEEASEMGVRIYQKPESNDIYELRRKKNPPLCEDNENPDAAWYVPMKTCIYEIPSAIEQHGAEWPEEWPKRLETYPEWLTSKEKAMEDTNHWNAMVNKSYLTGLGIDWLHIRNVMDMTAIYGGFGASLVKQNVWVMNVVPVHSPDTLPFIYERGLLGIYHDWCEPFGTYPRSYDLLHADHLFSRLKNRCKQPASIVVEMDRLTRPGGWVVVRDKVEILEPLEEILRSLHWEIRMTYAQDKEGMLCAQKTLWRP

SEQ ID NO: 807 - DNA, 2435 bp, Arabidopsis thaliana
  G2754,family:SWI/SNF
caatataccctcggttttgaatttgctctcaaaagcgacggagacgactgtttggctcggtgatttctcccgccgtttgggtttttcttaccggaatttccttctccttcgatggttagtctgcgctccagaaaagttattccggcttcggaaatggtcagcgacgggaaaacggagaaagatgcgtctggtgattcacccacttctgttctcaacgaagaggaaaactgtgaggagaaaagtgttactgttgtagaggaagagatacttctagccaaaaatggagattcttctcttatttctgaagccatggctcaggaggaagagcagctgctcaaacttcgggaagatgaagagaaagctaacaatgctggatctgctgttgctcctaatctgaatgaaactcagtttactaaacttgatgagctcttgacgcaaactcagctctactctgagtttctccttgagaaaatggaggatatcacaattaatgggatagaaagtgagagccaaaaagctgagcccgagaagactggtcgtggacgcaaaagaaaggctgcttctcagtacaacaatactaaggctaagagagcggttgctgctatgatttcaagatctaaagaagatggtgagaccatcaactcagatctgacagaggaagaaacagtcatcaaactgcagaatgaactttgtcctcttctcactggtggacagttaaagtcttatcagcttaaaggtgtcaaatggctaatatcattgtggcagaatggtttgaatggaatattagctgatcaaatgggacttggaaagacgattcaaacgatcggtttcttatcacatctgaaagggaatgggttggatggtccatatctagtcattgctccactgtctacactttcaaattggttcaatgagattgctaggttcacgccttccatcaatgcaatcatctaccatggggataaaaatcaaagggatgagctcaggaggaagcacatgcctaaaactgttggtcccaagttccctatagttattacttcttatgaggttgccatgaatgatgctaaaagaattctgcggcactatccatggaaatatgttgtgattgatgagggccacaggttgaaaaaccacaagtgtaaattgttgagggaactaaaacacttgaagatggataacaaacttctgctgacaggaacacctctgcaaaataatctttctgagctttggtctttgttaaattttattctgcctgacatctttacatcacatgatgaatttgaatcatggtttgatttttctgaaaagaacaaaaacgaagcaaccaaggaagaagaagagaaaagaagagctcaagttgtttccaaacttcatggtatactacgaccattcatccttcgaagaatgaaatgtgatgttgagctctcacttccacggaaaaaggagattataatgtatgctacaatgactgatcatcagaaaaagttccaggaacatctggtgaataacacgttggaagcacatcttggagagaatgccatccgaggtcaaggctggaagggaaagcttaacaacctggtcattcaacttcgaaagaactgcaaccatcctgaccttctccaggggcaaatagatggttcatatctctaccctcctgttgaagagattgttggacagtgtggtaaattccgcttattggagagattacttgttcggttatttgccaataatcacaaagtccttatcttctcccaatggacgaaacttttggacattatggattactacttcagtgagaaggggtttgaggtttgcagaatcgatggcagtgtgaagctggatgaaaggagaagacagattaaagatttcagtgatgagaagagcagctgtagtatatttctcctgagtaccagagctggaggactcggaatcaatcttactgctgctgatacatgcatcctctatgacagcgactggaaccctcaaatggacttgcaagccatggacagatgccacagaatcgggcagacgaaacctgttcatgtttataggctttccacggctcagtcgatagagacccgggttctgaaacgagcgtacagtaagctcaagctggaacatgtggttattggccaagggcagtttcatcaagaacgtgccaagtcttcaacacctttagaggaagaggacatactggcgttgcttaaggaagatgaaactgctgaagataagttgatacaaaccgatataagcgatgcggatcttgacaggttacttgaccggagtgacctgacaattactgcaccgggagagacacaagctgctgaagcttttccagtgaagggtccaggttgggaagtggtcctgcctagttcgggaggaatgctgtcttccctgaacagttaggacacattaataagccaggccttgaaacc

SEQ ID NO: 808 - protein, 764 aa, Arabidopsis thaliana
  G2754,SWI/SNF domain coordinates 198-393,554-638
MVSLRSRKVIPASEMVSDGKTEKDASGDSPTSVLNEEENCEEKSVTVVEEEILLAKNGDSSLISEAMAQEEEQLLKLREDEEKANNAGSAVAPNLNETQFTKLDELLTQTQLYSEFLLEKMEDITINGIESESQKAEPEKTGRGRKRKAASQYNNTKAKRAVAAMISRSKEDGETINSDLTEEETVIKLQNELCPLLTGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESWFDFSEKNKNEATKEEEEKRRAQVVSKLHGILRPFILRRMKCDVELSLPRKKEIIMYATMTDHQKKFQEHLVNNTLEAHLGENAIRGQGWKGKLNNLVIQLRKNCNHPDLLQGQIDGSYLYPPVEEIVGQCGKFRLLERLLVRLFANNHKVLIFSQWTKLLDIMDYYFSEKGFEVCRIDGSVKLDERRRQIKDFSDEKSSCSIFLLSTRAGGLGINLTAADTCILYDSDWNPQMDLQAMDRCHRIGQTKPVHVYRLSTAQSIETRVLKRAYSKLKLEHVVIGQGQFHQERAKSSTPLEEEDILALLKEDETAEDKLIQTDISDADLDRLLDRSDLTITAPGETQAAEAFPVKGPGWEVVLPSSGGMLSSLNS

SEQ ID NO: 809 - DNA, 1304 bp, Arabidopsis thaliana
  G2766,family:HLH/MYC
ctttctctcaaaccctctcctcaagattttttcctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaagacagaaagaaacatagcaaaaaggagttattttggaggtctaaagaaagtgatgatggattaatgaaggctggttttgttactctctgaaagtcttgacctttattataacttaaaattcgatcaatcgattttttttttcctgttttcctcaaagttggttaattttagcttagagcaaaacccattatttgagattgaaagagatgcgcgtttgtgtgtg

SEQ ID NO: 810 - protein, 309 aa, Arabidopsis thaliana
  G2766,HLH/MYC domain coordinates 234-292
MYPPNSSKSTAHDGGGDADTNQYDSAAGATRDFSSLGPQTHHHPPPQRQQQHQQNPNLVGHYLPGEPSSIGFDSNASSSSSLFRHRSSPAGFYDQHLPTDPNGFSLGRPNGGYGGGGEQGPSRLKSELRFSSGSSSHQEHNSLPRISEVEAAAAARNGVASSSMSFGNNRTNNWDNSSSHISFTIDQPGKRSKNSDFFTLETQYSMPQTTLEMATMENLMNIPEDSVPCRARAKRGFATHPRSIAERERRTRISGKLKKLQELVPNMDKQTSYADMLDLAVEHIKGLQHQVESLEKGMERCTCGACKKR

SEQ ID NO: 811 - DNA, 1315 bp, Arabidopsis thaliana
  G277,family:AKR
ggggacacgaattcgattctctcttatctcgacgagaaaaccctactgcgaaaaaactccgatctctctggcgagaagtaaatttttatctctgagcttggtttcaccatttctctatctctatctcctcgctgggttacggtttggtaaggtcagtgttctctaaggctgaaatttgggggtttctcagtctcgatgtggtcgtgctccgttaggattcttcacaatcattagggttatatttcttacaaactgatgctcattttctcttccctgtctatggctttatctgtgatccttcaaaagcttagtgtcttcggccctggtttgaatccttctttcccttactgcatcgccaatcactcctttgcctcccgttaattgagttgctctctttcaacttaattacattagtctgcttcctttgctgtctagtctggatagtgttgcaaatcaagtagtatcttctttagacattcttggctgagagatttacactaaaagcatagaataagaaacccctgtttggttagtatctacccgagtctcgtagtcctacacagatccggatcctagtttcgaagctagttcttgtttagctgaagctcagacccaaaatgctccaagaaccgtcggctgcattctccctccggcgtaactcattcagacgccgatctcccagatcaaatgtcgatgacagaggctggaatccgctccatatcaaagccagaaaaggcgatctgaaatctgtcaagcagcttctcgaccaaggaatggatgtgaatgctctagcatggggacccaaatcaaaaggagtgagtgcacttcaccttgcagcagagggaggtcacattgaagtcatggatttactcctagaacgtggggccaacattgatgctaaaacatggggctcatgcgggtggactcctctccacgctgcagccaaagagcggaagagagaagcagtgaagtttctggtggagaacggcgcattcttggcagatgatataactgataccaggtttaatccgccggtgcattactgtcacggccttgaatgggcgtacgaggaaatgaagaagcttaacagcgagtcttcttcttcatctggtggagacacatcttccagttctgacaactgaacttcttcttggttgtttctcggtgtgttttgttttgttttctagttgagactacttatcagaactattatggttggtgtttgatcttatgggctatgtgaaacattgaaactgcggatacattcatgtaatcttcagtgtgttattttgcaactccagtttgatatcctaaa

SEQ ID NO: 812 - protein, 174 aa, Arabidopsis thaliana
  G277,AKR domain coordinates 28-173
MLQEPSAAFSLRRNSFRRRSPRSNVDDRGWNPLHIKARKGDLKSVKQLLDQGMDVNALAWGPKSKGVSALHLAAEGGHIEVMDLLLERGANIDAKTWGSCGWTPLHAAAKERKREAVKFLVENGAFLADDITDTRFNPPVHYCHGLEWAYEEMKKLNSESSSSSGGDTSSSSDN

SEQ ID NO: 813 - DNA, 1089 bp, Arabidopsis thaliana
  G2774,family:HLH/MYC
atgcaacttcgacattaaattccaaagtaaactacacaattaagaacatgacggaagagtttgagatcgcaggaatctccaccggagcttggtggagctcgccaacaaacaccgccgcagtattctctggctactcgctgccatgttccactgagattagccctgatgtcacaaatttcggatggcaaaacttcgataacaagattaacgatcataatgatggttgtatgaacatgcataatagtttcttcgaaggactattaatcgatcctaacgatcaattactaccggatccatggtccaaaagtacaattcctaacgctaaatctgagctccttgaaaacttcccattcttagataacatgttcttggtcgattcagaagctgaatctttgttggatcatgaaatcagaaaccataagtcgtctaaggagcaaattacacaagactacaagaatcttacttcaaaggcacaattagaagagaacagcgatgagtattcaccgcgattactaaaaagaccgagactcgagacactatctccattgccaagcttcaaagttcgtaaagaaaaactcggagatagaatcactgcgcttcagcaactggtttctccatttggcaagacagatacagcttctgttctcaacgaagctgtagagtacataaagtttcttcaagaacaagtcactgtattgagtaatccagaacagaacaccataggatctgttcaacaacagcagtgttcaaacaagaaatctatcaatactcaaggagaagtagaagaagacgaatgtagtccaagaagatatgtagatctttcgagccgtggactatgtctaatgccgatctcagcttcatatcccgtggctgcagctgcggcttcggctgcagagatgaacgtacatctggtttctggcatcttccattctttgtaaacttataaactaaatacgtagatacataaacaaacaaagtaatcttccgcaaacaggggatcttgtaaagttttatgtccctttttaatttatacagaaatgtaaatgtcctgtaatacttcaaaatcatatattgtttgtttgcgtacgt

SEQ ID NO: 814 - protein, 296 aa, Arabidopsis thaliana
  G2774,HLH/MYC domain coordinates 158-215
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKAQLEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 815 - DNA, 1016 bp, Arabidopsis thaliana
  G2779,family:HLH/MYC
aaagaagttgtcagaaaaaaaaaaaaaaaaaagtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtcatatatacgacccaacttgggataatatttgtaatctgtatacttgtaatttcgacgatataaatttattggtgacttataattgtc

SEQ ID NO: 816 - protein, 260 aa, Arabidopsis thaliana
  G2779,HLH/MYC domain coordinates 148-206
MANFENLSSDFQTIAMDIYSSITQAADLNNNNSNLHFQTFHPSSTSLESLFLHHHQQQLLHFPGNSPDSSNNFSSTSSFLHSDHNIVDETKKRKALLPTLSSSETSGVSDNTNVIATETGSLRRGKRLKKKKEEEDEKEREVVHVRARRGQATDSHSLAERVRRGKINERLRCLQDMVPGCYKAMGMATMLDEIINYVQSLQNQVEFLSMKLTAASSFYDFNSETDAVDSMQRAKARETVEMGRQTRDGSPVFHLSTWSL

SEQ ID NO: 817 - DNA, 1040 bp, Arabidopsis thaliana
  G2789,family:AT-hook
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 818 - protein, 265 aa, Arabidopsis thaliana
  G2789,AT-hook domain coordinates 59-67,68-208
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 819 - DNA, 781 bp, Arabidopsis thaliana
  G279,family:HMG
cacaaacacgtagttattctctctttactctctctatttctctctcttcaaaccctacgaagatcttcttcttcttcttcaagaatcgatcatgaaaggagctaaatctaaggctgaaaccaggagcacaaagctctctgtgactaagaagcctgctaagggagccaaaggtgctgctaaagatccaaacaaacctaagaggccttccagtgccttcttcgttttcatggaagatttccgtgtgacgtacaaggaggagcaccctaagaacaagtctgttgctgctgttggcaaagctggtggtgaaaagtggaaatccttgtctgactctgagaaggctccttatgtggctaaggctgacaagcgcaaggttgagtatgagaagaacatgaaagcctacaacaagaaattggaggaaggccctaaggaagatgaggaatctgacaagtcagtttcagaggttaacgatgaggatgatgctgaggatggcagtgaagaggaggaagacgatgattaagaagttgaagttgtggtagcgtaatatagaaggctgcaaggaatctctcggatgtttttatctcctctcttaaaatgttaattcgggtggttaaagtggtttttttttttttctttttctttttcttactgatgtttcgttttagtaaactattacctatctcccactgattctacgggtaatggaaaaagtgaatgtagaatgtttagatggtgaaatgagagatttgtagctctaaaaaaaaaaaaaaaaaaaaaaaaaaaa

SEQ ID NO: 820 - protein, 141 aa, Arabidopsis thaliana
  G279,HMG domain coordinates 31-103
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 821 - DNA, 1128 bp, Arabidopsis thaliana
  G2790,family:HLH/MYC
actttctctttgttttctttctaacctctttccacgaaaagtcacgatgggagataccgcagaggatcaggacgaccgagctatgatggaagctgaaggagtaacgagcttctccgaacttcttatgttctctgacggcgttctcagctcctcttccgaccaccaacctgagggtaatgtcggcgatggtggagaagacagtttaggttttgtattctccggcaaaactggctcaagaatgctctgttttagtggaggctatcaaaacgacgacgagtcactcttcctagaaccttctgttccaacctccggagtctctgatcttgacccttcatgcattaagattgattgcaggaactcaaacgacgcgtgtacggtcgataaatctactaaatcatcaaccaagaagagaaccggaacgggtaatgggcaagagtcggatcaaaatcgaaaaccgggcaagaaagggaaacgaaatcaagagaaatcatcagttggaattgcaaaggtcaggaaagaaaggttaggggaaagaattgcagcgttgcagcagttggtttctccatacggcaagacagatgcagcttctgtgttgcatgaagcgatgggttacatcaaattcttacaagatcagattcaagtcctttgctctccttatctaatcaaccattctcttgacggtggagttgtcaccggagatgtaatggcggcgatgaaagcgaaagacttgagaagcagaggattatgtctagtacctgtctcatccaccgtacacgtggaaaattccaacggtgctgatttctggtcacctgctactatgggtcacactacgtcaccgtcgttacctcaaggattttaattaaacggtcgtaggctgatatatattagtagtattttagtagccttttttcttgggttttgtttttggctgaagaactattactagtaaatgttacacccagacatttttttgggattatctgggtggtataaaaaggttggaatcttttgtgtttgtaaaattagattgtctaagttttcttaaagtttctttgatgtcactgtcacagttgcgacgagtagtgatggtacttactgaaaggctaagcttattcacgctcttaaagt

SEQ ID NO: 822 - protein, 270 aa, Arabidopsis thaliana
  G2790,HLH/MYC domain coordinates 141-198
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQEKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 823 - DNA, 1026 bp, Arabidopsis thaliana
  G2791,family:HLH/MYC
agaagaagagaagaagagatggaaaatggaaatggagaaggaaaaggagaattcataaaccaaaacaatgacttcttccttgattccatgtcaatgctctcctctctccctccttgttgggatccatctcttcctcctcctcctcctccgccacaatctcttttccacgctctagccgtcgacgcccccttccccgaccagttccatcatcctcaggagtcaggaggtccaacaatgggtagccaagaagggttacagccacaaggtacagtgtcgaccacgagcgcacctgttgttcgtcaaaagccaagagttcgagccaggagaggccaagccaccgatcctcacagtatcgctgagaggcttagaagggaacgcatcgcagagcgtatgaagtctctccaagaactggttcccaacaccaacaagacggataaggcatcaatgttggacgagatcatcgagtatgttaggttccttcagcttcaagtcaaagtactaagcatgagcagattgggaggtgcaggatcagttggtccacgcctcaatggtctctccgcagaggcaggaggacggctcaatgccctcactgcaccgtgcaatggcttaaatgggaatggaaacgctacaggatcgtccaatgagagcctaaggtcaacagaacaaagagtggcgaaactgatggaggaagacatgggatcagcaatgcaataccttcaagggaaggggctttgcttaatgccaatatctctcgcaaccgcgatatcatcatcaactactcactctcgtggatccctctttaaccccatctccagtgctgtagcagcagaggattcaaatgtaacagcaactgcagttgctgcacctgaagcctcgtctactatggatgatgtatctgcttccaaggcctgaaccatagaatactcatgtgtttcgttttctcagtttaagtcaaacgctaatctccctatctttttactattttctctgctaagcaacaataatataaaacagttgcaacaaaaa

SEQ ID NO: 824 - protein, 297 aa, Arabidopsis thaliana
  G2791,HLH/MYC domain coordinates 102-159
MENGNGEGKGEFINQNNDFFLDSMSMLSSLPPCWDPSLPPPPPPPQSLFHALAVDAPFPDQFHHPQESGGPTMGSQEGLQPQGTVSTTSAPVVRQKPRVRARRGQATDPHSIAERLRRERIAERMKSLQELVPNTNKTDKASMLDEIIEYVRFLQLQVKVLSMSRLGGAGSVGPRLNGLSAEAGGRLNALTAPCNGLNGNGNATGSSNESLRSTEQRVAKLMEEDMGSAMQYLQGKGLCLMPISLATAISSSTTHSRGSLFNPISSAVAAEDSNVTATAVAAPEASSTMDDVSASKA

SEQ ID NO: 825 - DNA, 1653 bp, Arabidopsis thaliana
  G2792,family:HLH/MYC
accaacaaaataaaagaaagaagcaaaaagaaaaagctcgaagataggaaaatgttaagggaagaatgtactccaagttcatcatggtgggaagatgttcaacatcatcataatgatcatgcaaactcgattagttcgacgtctttctaccataagagtagtaataataactcacacgccaacgctagctgtgaagaagacaatctctccgtctctaccgtacgcgcttcgaatcgtttggacctaaccgctgaatcctccaatcatcactctctctcggcttcgaatcagcctgcctcctcctccgatgagttgcttcgcgaccatgtagtatcttctcataatcatctatggagtcttgccttcttgcctggtagaagcttaggagatcaaatgatggatcatcatcatcacatagcatcaagaaattcatcaacaacatcagaattaccatcattcgagccagcgtgccataacggtaatggtaacggttggatctatgacccaaatcaagttaggtacgatcaaagtagtgaccaacggctgtcaaagttgacggatcttgtaggcaagcactggtcaattgcaccaccgaataatcccgacatgaaccataaccttcatcatcacttcgatcatgatcattctcaaaacgacgacatttctatgtacagacaagccttggaggtgaaaaatgaggaagatctttgttacaataatggctcaagtggtggtggttccttgttccatgatcctatagaaagttctagaagtttccttgatataaggttaagtaggccattaacggatattaatccgtcatttaagccatgctttaaggccttaaacgtatccgagtttaacaagaaagaacatcaaacggcatctctggcagcagtgagactgggaacaacaaacgctggaaaaaagaagagatgtgaagaaatttccgatgaggtttcaaagaaggccaagtgcagtgagggctctacactttcgccagagaaggaactacccaaagccaaacttcgagacaagatcacgactctacagcaaattgtgtctccctttggaaagactgatactgcttctgtgcttcaagaggccatcacttacataaatttttatcaagagcaagttaagctgctaagcactccttatatgaagaattcatcaatgaaggatccatgggggggatgggacagagaagatcacaacaaaaggggaccgaagcatcttgatctaaggagtagagggctttgtttggttcctatttcatataccccaatcgcataccgcgataacagtgcaactgactactggaatcccacgtatagaggttctttgtatcgttagtgactagtatagcaaaaagtgtgtagagagaaagatttgattaaattatggtagtggtaaaccattccaaacatcgatcattttatagggagcaagcagtaaaacgggagaagagtatgtgtacataaagtatatgcatattaatcattggggtcacacttctttgatttgcaattgttcttgcgtaacctaaaacattgtgttatggtcatatatagaataatacattaatattggagtttgaattagatatactacaatgtaataaaaagtagttaattaatggcatattccttg

SEQ ID NO: 826 - protein, 434 aa, Arabidopsis thaliana
  G2792,HLH/MYC domain coordinates 307-364
MLREECTPSSSWWEDVQHHHNDHANSISSTSFYHKSSNNNSHANASCEEDNLSVSTVRASNRLDLTAESSNHHSLSASNQPASSSDELLRDHVVSSHNHLWSLAFLPGRSLGDQMMDHHHHIASRNSSTTSELPSFEPACHNGNGNGWIYDPNQVRYDQSSDQRLSKLTDLVGKHWSIAPPNNPDMNHNLHHHFDHDHSQNDDISMYRQALEVKNEEDLCYNNGSSGGGSLFHDPIESSRSFLDIRLSRPLTDINPSFKPCFKALNVSEFNKKEHQTASLAAVRLGTTNAGKKKRCEEISDEVSKKAKCSEGSTLSPEKELPKAKLRDKITTLQQIVSPFGKTDTASVLQEAITYINFYQEQVKLLSTPYMKNSSMKDPWGGWDREDHNKRGPKHLDLRSRGLCLVPISYTPIAYRDNSATDYWNPTYRGSLYR

SEQ ID NO: 827 - DNA, 964 bp, Arabidopsis thaliana
  G28,family:AP2
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 828 - protein, 268 aa, Arabidopsis thaliana
  G28,AP2 domain coordinates 145-208
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 829 - DNA, 983 bp, Arabidopsis thaliana
  G280,family:AT-hook
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 830 - protein, 204 aa, Arabidopsis thaliana
  G280,AT-hook domain coordinates 97-104,130-137-155-162,185-192
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 831 - DNA, 843 bp, Arabidopsis thaliana
  G2800,family:NAC
atgtctcctccgtcgacgatagcttacgtattaccgccaggttttaagtttgtgccaaacgatgaagaagtcatccattgttacttgaaaccttactcggacggcaacacgaacgtattgctccatgttcctattcatctcgtcaatatctacgagtcgaatccacaaacactttcagaggaattccagaagggtaacgataaagaatggtttattataacggagaggaacaaagttgatcaaggtttaagccaaacaaagagagttggttatggtgcgaaaaggcagaaacgtgtcgacactaacggaggatattggcacgcaacagtggctgcccaaaagatcaacgctggagatggtgtcgttcgcaacaaaaggccactggcatactacgttgggaaaccatcagaaggcgtcaaaactgattggttaatgcaagaatactctcttgatcactcttctcacaacaacgacaaggattacactttgtgcaagatctatcttactccacaagcaacaaagatgaataaagaagtgggagaagagaagaagaagcagaagaaaggagaagccgttgtttcagttgcacctgtggaagcattggaagagcagctgccttgtaatgtcgagtatcatcaaccgctagcaccgctagattcttgccaaccgcagcctcatgatttggcgtatcaacagcagcagttttgtccaggcccactggattcttatcaaccgcagcctcatgatatggagaatcagcaaccgcataatgagaagctgaagaaagaagaagacgttgagcagctggatttgcatcaaccagaccaaggaaaaggatgctaa

SEQ ID NO: 832 - protein, 280 aa, Arabidopsis thaliana
  G2800,NAC domain coordinates 11-150
MSPPSTIAYVLPPGFKFVPNDEEVIHCYLKPYSDGNTNVLLHVPIHLVNIYESNPQTLSEEFQKGNDKEWFIITERNKVDQGLSQTKRVGYGAKRQKRVDTNGGYWHATVAAQKINAGDGVVRNKRPLAYYVGKPSEGVKTDWLMQEYSLDHSSHNNDKDYTLCKIYLTPQATKMNKEVGEEKKKQKKGEAVVSVAPVEALEEQLPCNVEYHQPLAPLDSCQPQPHDLAYQQQQFCPGPLDSYQPQPHDMENQQPHNEKLKKEEDVEQLDLHQPDQGKGC

SEQ ID NO: 833 - DNA, 1497 bp, Arabidopsis thaliana
  G2802,family:NAC
atgaacaagagtaatcctgctggttcggtgactggttcggatataatagacgccaagatcgaagaacatcaactttgtggatccaagaagtgtcctagctgcggccacaagctcgaaggcaaaccacaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaa

SEQ ID NO: 834 - protein, 498 aa, Arabidopsis thaliana
  G2802,NAC domain coordinates 48-196
MNKSNPAGSVTGSDIIDAKIEEHQLCGSKKCPSCGHKLEGKPQDWVGLPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHLGTHEEEKEGELVVSKIFYQTQPRQCNWSSSTSSLNAIGGGGGEASSGGGGGEYHMRRDSGTTSGGSCSSSREIINVNPPNRSDEIGGVGGGVMAVAAAAAAVAAGLPSYAMDQLSFVPFMKSFDEVARRETPQTGHATCEDVMAEQHRHRHQPSSSTSHHMAHDHHHHHHQQQQQRHHAFNISQPTHPISTIISPSTSLHHASINILDDNPYHVHRILLPNENYQTQQQLRQEGEEEHNDGKMGGRSASGLEELIMGCTSSTTHHDVKDGSSSMGNQQEAEWLKYSTFWPAPDSSDNQDHHG

SEQ ID NO: 835 - DNA, 639 bp, Arabidopsis thaliana
  G2803,family:NAC
atgggcccaacatacagagctttgccagtaggtatgaggtttcgtccttcagatttggagttggctgtttactttttgatcaagaaagctttaggacttcccatgaaagctcttactgtgcccgacgaatgtaatgatatcttctcaacacatcctcgcgacttgcctggctatggaagcgaagagcattggtacttctactgcaagaaacccaagaatcaagttactagaacgaaatcttataacctctggataccaacgggagaaaaaactgatgtgttagatccaaagaagaatggcggcgaattagtcggtatcaagcattcgtttactttcattgagaacgaagaagaagaagaatctgataacaagaacggcgatgaagaagaacctccacaatgcaattggttcttggatgaaatcagcctcccattgacagttgtggatactgattggactctgtgtcatatcttttacgagaaggttaaacctgaatttggtaatttgcatatagtcgaatctgaatccgaatccgaagaagaagaagaagatgaaagtgttgataagcctgcagagagtttggatagtgttaaagagaaagatggaactgttcttcctccacctcctgctacaccttag

SEQ ID NO: 836 - protein, 212 aa, Arabidopsis thaliana
  G2803,NAC domain coordinates 8-160
MGPTYRALPVGMRFRPSDLELAVYFLIKKALGLPMKALTVPDECNDIFSTHPRDLPGYGSEEHWYFYCKKPKNQVTRTKSYNLWIPTGEKTDVLDPKKNGGELVGIKHSFTFIENEEEEESDNKNGDEEEPPQCNWFLDEISLPLTVVDTDWTLCHIFYEKVKPEFGNLHIVESESESEEEEEDESVDKPAESLDSVKEKDGTVLPPPPATP

SEQ ID NO: 837 - DNA, 885 bp, Arabidopsis thaliana
  G2804,family:NAC
atggctaagaaagagaagatcgagcaagtgatttcaatgggtggaataatgtgggaaggtctcaattcgagtttaatcaaagtcgatgaagctttgcttaagcagcagatccgagaattcgagaagggtaacgataaagaatggtttattataacggagaggaacaaagttgatcaaggtttaagccaaacaaagagagttggtaatggtgcgaaaaggcagaaacgtgttgacactaacggaggatattggcacgcaacagtggctgcccaaaagatcaacgctggagatggtgtcgttggcaacaaaaggccacttgcatactacgataggaaaccatcagaagacgtcaaaactgattggttaatgcaagaatactctcttgatcacaacaacgacaaggtaagattacactttgtgcaagatttatcttactccacaagcaacaaagaagttggagaagagaagaagaagcagaagaaaggagaacctgtggaagcatcggaagggcagcagccttgtaatgccgagtatcatcaaccgctagcacctctagattcttgccaaccgcagcctcatgatttggctgagcagctggatttgcatcaaccagaacagttgcagctgcaacagcctcatgatattgtgtatcaaccacagtattgtttacttccagaacaacatcagctgcagccttttcctgataacttttctgagttgaacagctttcaacagcaaccagtgatgatcccagacgatttagaagatttcttggctgaattaatggagccacattcactggatggagatgaagaatccaacaattatgggttttttgaaggcttatttgacacagaaggaattaatgataaaacattacactaa

SEQ ID NO: 838 - protein, 294 aa, Arabidopsis thaliana
  G2804,NAC domain coordinates 38-130
MAKKEKIEQVISMGGIMWEGLNSSLIKVDEALLKQQIREFEKGNDKEWFIITERNKVDQGLSQTKRVGNGAKRQKRVDTNGGYWHATVAAQKINAGDGVVGNKRPLAYYDRKPSEDVKTDWLMQEYSLDHNNDKVRLHFVQDLSYSTSNKEVGEEKKKQKKGEPVEASEGQQPCNAEYHQPLAPLDSCQPQPHDLAEQLDLHQPEQLQLQQPHDIVYQPQYCLLPEQHQLQPFPDNFSELNSFQQQPVMIPDDLEDFLAELMEPHSLDGDEESNNYGFFEGLFDTEGINDKTLH

SEQ ID NO: 839 - DNA, 636 bp, Arabidopsis thaliana
  G2809,family:HB
atggtaaaaaaaaaaaaggaaaaggagaaaagcaaagaaatagaggagatggatagagagatccaaaacggtgcgtatagtgggagagtgatgactgaggagcagatggagattctccgtaagcagatcgccgtttacgccgttatttgtgaccaactcgtcctcctccacaactccctctcttcttaccatccactctcatcaggagtgaggccaatggttggcggatactttgatccgatgggggcatcgtcaagttctcataggatatcgactaggcatcggtggactccgacttcaacacagcttcagatacttgagagcatttacgacgaaggaagtggaacaccgaatcgacggaggattagagagatcgcgacggagctgtctgaacatggacagatcacggagacaaatgtctacaattggtttcaaaaccggcgagctcggtccaaacgaaagcagcctcaaacgacgacagctaatggtcaggctgacgatgtggcggtgacaacggaggaaaggaggagttgtggagattcagggggattagagtcttatgagcatatactcttcccaagtcctgacttagggattgagcatttgttgagtatagggaaatttatggagacttaa

SEQ ID NO: 840 - protein, 211 aa, Arabidopsis thaliana
  G2809,HB domain coordinates 95-155
MVKKKKEKEKSKEIEEMDREIQNGAYSGRVMTEEQMEILRKQIAVYAVICDQLVLLHNSLSSYHPLSSGVRPMVGGYFDPMGASSSSHRISTRHRWTPTSTQLQILESIYDEGSGTPNRRRIREIATELSEHGQITETNVYNWFQNRRARSKRKQPQTTTANGQADDVAVTTEERRSCGDSGGLESYEHILFPSPDLGIEHLLSIGKFMET

SEQ ID NO: 841 - DNA, 1884 bp, Arabidopsis thaliana
  G2818,family:SWI/SNF
atgacagaggatgatgattttgatgagcagaatgcagtcattgctgaagctgctgagcagcctctagatttgattataccgctactaaagtaccaaaaggagtttttggcttgggctacaatacaggaactatcagccgtaagaggaggcattctcgctgatgagatgggaatggggaaaacaatacaagccatctctctcgttcttgccagacgggaagttgacagagccaaatctagggaagcagttgggcacacccttgtgcttgttcctcctgttgctctttctcagtggttagatgagatttctcggttgacatccccgggaagcaccagggttcttcaataccatgggccgaagagagacaagaatgttcaaaagttaatgaattacgactttgttttgacaacatctcccatagttgagaatgaatataggaaggatgaaggagtggacgaaacaatgtctcctttacactctattaagtggaatcgtatcatcgtcgatgaggctcatgatatcaaaaacagaagtagtcgcactgccaaagctgtttttgctttggaggcgacctacagatgggctctgagtggtacccctctccagaatgatgttgacgagctctactccctgatacgcttccttcgcgtttcgccatactcatattacttttgcaagaaatgtgactgtgaagttcttgatcggagtgcgcatcgaaaatgtcccagctgtcctcataatgcaaatcaacacatctcttggtggaaagagaatgtggacaaacggagaaacagagcctgtatattccttaaacaaaatgttctaaaggacattctactaagacgtactaaattgggccgggcagctgaccttgctcttccttctagaatcatctctctgaggcgagatgcactaagtgtagtagaagctgatttctatgaatcactatacaaagttagcaagacaacatttgatgggtatattcaggctgggacattgatgaataactatgcacatatatttggtcttcttatccgactgagacaagctgttgatcatccatacctggtgagttattctagtcctagtggcgctaacgctaacttgcttgatgcgaacaaaaatgagaaagaatgtggtttcggccatgacccttccaaggactactttgtgacttctagtgaacatcaggcaagcaagacaaagcttaaaggatttagagcctctagcattttaaatcggataaacctcgatgattttaaaacaagtacaaagattgaggctttgagagaagaaatcaggttcatggttgaaagagattggtctgccaaagcaatagtattcagccagttcacatcattcttggacctgataagttacgccttggggaagtctggggttagctgtgttcaactggtgggaagcatgtccaaggcagctaaagatgctgcactcaaaaattttaaagaagagccagattgcagagttttattaatgagcttgcaagctggaggggttgctctaaatctaacagccgcttcgcatgtgttcatgatggacccgtggtggaacccagcggttgagaggcaagcacaggacagaatacataggatcggacagtgcaagcctgtcagggttgtaagattcataatggagaaaacagtagaggaaaagatactaacgcttcaaaagaagaaggaagatttgtttgaaaggtttcttattttaaacgatacgcttctctcaactttgctggtttcttattgtcaactgtatgaagcctatatgaagacatatttgctttgttacagtacgttaggtgactctgaagaggccgttgtacaaaagctgggagaagacgatatcaagtccctgttcgcataa

SEQ ID NO: 842 - protein, 627 aa, Arabidopsis thaliana
  G2818,SWI/SNF domain coordinates 24-239,456-539
MTEDDDFDEQNAVIAEAAEQPLDLIIPLLKYQKEFLAWATIQELSAVRGGILADEMGMGKTIQAISLVLARREVDRAKSREAVGHTLVLVPPVALSQWLDEISRLTSPGSTRVLQYHGPKRDKNVQKLMNYDFVLTTSPIVENEYRKDEGVDETMSPLHSIKWNRIIVDEAHDIKNRSSRTAKAVFALEATYRWALSGTPLQNDVDELYSLIRFLRVSPYSYYFCKKCDCEVLDRSAHRKCPSCPHNANQHISWWKENVDKRRNRACIFLKQNVLKDILLRRTKLGRAADLALPSRIISLRRDALSVVEADFYESLYKVSKTTFDGYIQAGTLMNNYAHIFGLLIRLRQAVDHPYLVSYSSPSGANANLLDANKNEKECGFGHDPSKDYFVTSSEHQASKTKLKGFRASSILNRINLDDFKTSTKIEALREEIRFMVERDWSAKAIVFSQFTSFLDLISYALGKSGVSCVQLVGSMSKAAKDAALKNFKEEPDCRVLLMSLQAGGVALNLTAASHVFMMDPWWNPAVERQAQDRIHRIGQCKPVRVVRFIMEKTVEEKILTLQKKKEDLFERFLILNDTLLSTLLVSYCQLYEAYMKTYLLCYSTLGDSEEAVVQKLGEDDIKSLFA

SEQ ID NO: 843 - DNA, 735 bp, Arabidopsis thaliana
  G2826,family:Z-C2H2
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 844 - protein, 244 aa, Arabidopsis thaliana
  G2826,Z-C2H2 domain coordinates 75-95
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 845 - DNA, 1668 bp, Arabidopsis thaliana
  G2831,family:Z-C2H2
acccttttcaatctcttccaacaaaacttttgtccaagaagaagacatgacaactgaagatcagacaatttcaagtagtggaggatatgtccaaagctcatcaacaactgatcatgttgatcatcatcatcatgatcaacatgaatccctcaatcctcctcttgtcaagaagaagagaaacctccctggaaatcctgatccagaagctgaggtcatagctctatctccaaagacacttatggccacaaatcgtttcctctgcgagatatgtggaaaagggtttcaaagagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttgaaacactctttaatggatttttctaccttatttatgagtgaacttaattatcaaagctgatttctttaattaattttaaaaatgatttatttcaccagacca

SEQ ID NO: 846 - protein, 506 aa, Arabidopsis thaliana
  G2831,Z-C2H2 domain coordinates 72-92,148-168
MTTEDQTISSSGGYVQSSSTTDHVDHHHHDQHESLNPPLVKKKRNLPGNPDPEAEVIALSPKTLMATNRFLCEICGKGFQRDQNLQLHRRGHNLPWKLKQRTSKEVRKRVYVCPEKSCVHHHPTRALGDLTGIKKHFCRKHGEKKWKCEKCAKRYAVQSDWKAHSKTCGTREYRCDCGTIFSRRDSFITHRAFCDALAEETARLNAASHLKSFAATAGSNLNYHYLMGTLIPSPSLPQPPSFPFGPPQPQHHHHHQFPITTNNFDHQDVMKPASTLSLWSGGNINHHQQVTIEDRMAPQPHSPQEDYNWVFGNANNHGELITTSDSLITHDNNINIVQSKENANGATSLSVPSLFSSVDQITQDANAASVAVANMSATALLQKAAQMGATSSTSPTTTITTDQSAYLQSFASKSNQIVEDGGSDRFFASFGSNSVELMSNNNNGLHEIGNPRNGVTVVSGMGELQNYPWKRRRVDIGNAGGGGQTRDFLGVGVQTICHSSSINGWI

SEQ ID NO: 847 - DNA, 793 bp, Arabidopsis thaliana
  G2836,family:Z-C2H2
acccaattccagtggaccttagttcccatgtttcaaaagtttcttcatcttcattgagaaccaacatggtttctcctttcagtatgcctttcatagctcaaactagtggttttgttaactattctcaagtttttatcactcaaaccatcgcaaaaaggtatcatgctcttattccgacaagcaatatggtcattgtccaaaatgataatgatcgtgtcaaccgtttcatgacttcttatccaccaattttgaaatctacagttaaccccccaaatgattttgataaacagtatgaaaccttcacacctaaacccatcgatttcttttgttcgcaacaagactatgcatgtcgtcagcatttggatatattttcatcctccccaaaacactatcatgagcaatatgttcataaaaatggtcggtcggtgaaatatatctgtaaaccaacagaggtccttgaagaaattcatgacgaaatcgattatgaaaaagacggtggttggatatatagcctgccgtttgagaaagacagttcatttatatgtctaaagtgcaatagtttgtttgatacttcacaaatgttggttgtacatacagagttaattcattctaagaatgagactaagaaaaggcttaaattacatcatcaagaattccatggtaaatctcataagatcaacaaagatcaaactggaggacaaagttgcagaagaaagttgaggcaatagagacgatcaagtgattatgaaactcccagcatcatgtatttggtaaggcggccgcactccgagat

SEQ ID NO: 848 - protein, 220 aa, Arabidopsis thaliana
  G2836,Z-C2H2 domain coordinates 160-181
MVSPFSMPFIAQTSGFVNYSQVFITQTIAKRYHALIPTSNMVIVQNDNDRVNRFMTSYPPILKSTVNPPNDFDKQYETFTPKPIDFFCSQQDYACRQHLDIFSSSPKHYHEQYVHKNGRSVKYICKPTEVLEEIHDEIDYEKDGGWIYSLPFEKDSSFICLKCNSLFDTSQMLVVHTELIHSKNETKKRLKLHHQEFHGKSHKINKDQTGGQSCRRKLRQ

SEQ ID NO: 849 - DNA, 1000 bp, Arabidopsis thaliana
  G2837,family:Z-C2H2
catggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgatt

SEQ ID NO: 850 - protein, 271 aa, Arabidopsis thaliana
  G2837,Z-C2H2 domain coordinates 140-160
MSNPNPEKTKVDVTEEEKEESDEQWSDEETNMREIVLGLPALNISSRIFGESSSVVEEDAEKARLNEQAVLAAGLILAAAEEAVMKGMNEGSGSGGKKKSRPRISTQTDDEGDGLGEGEAKKPKKKAKELTHPPKGPPVCHICGRGFGSWKAVFGHMRAHRDRNYQGFLPPPTFSAGAERFVIPGLRSAFTIATVGGGSSGGVAVGGRSSGDFSGSGGGDAPGSEGGRGSGIDLNVEPVEQVEEATESGCIAKFDLNKSPPKDEEEEDKPK

SEQ ID NO: 851 - DNA, 998 bp, Arabidopsis thaliana
  G2838,family:Z-C2H2
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 852 - protein, 191 aa, Arabidopsis thaliana
  G2838,Z-C2H2 domain coordinates 57-77
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 853 - DNA, 1203 bp, Arabidopsis thaliana
  G2840,family:Z-C2H2
atgccaactttgtacaaaaaagcaggctttaaaggaaccaattctgtcgactggatccctcaagctagattcttcatatacatgcatatacatatgatgaatcgagatgagcatattgcaaagaaagttgaaggatcaatctctagcttctccggggagaccagtacttcctcaaaacaaatctatgttaatcccgtgaccacgaccgggacgaaatcaatggaagacgacgacgtttcactctctcttctatacaatctatctaccttacatgaaaaagtccatcagatccaatctctggtcagcttctacatggtatctactaataacattaaccaatcctcggggtcaacgtctttggccgtggctaacatcggaagtttggttcaagagatcatcacggctgcttcatccatgttatatacttgccaacaactccaaatcggatctaacaacaacaacaacgatatcgataatgatcaaaccgtagatgcaatggttttggagttttcccgacaagaaaccgacccgggtcatgattttgtgcaagagtcgaccaacctttttggtgtccaagaaagagggcagatctcttttcccgaccagaatcttgattggtacaacaccgaaaccataaaccctaaaaaagataaacatcgttctaaaccaagttccgggagctacgatatactggagctagacgtagcggacctactagcgaaatacacgcattactgccagatttgtgggaaagggtttaagagagacgctaatctaaggatgcacatgagagcgcacggggatgagtacaagacacgtgaggccttgatcagcccaacgagccaagacaagaaaggaggatactcgttaaagaaacattactactcctgtcctcaacacgggtgtagatggaaccagaggcacgagaagtttcaaccgttgaaatctgtgatttgcgccaagaatcattacaagaggagtcattgtcccaaaatgtatatgtgcaggagatgtagtgtgaagcatttctcggttctgtctgatcttaggacacacgagaagcattgtggggatataaagtgggtttgctcttgtgggactaaattttctaggaaagacaagctgatgagccacgtttctttgtttttgggccacgtaccggcacatgggtcgtccaagccgccgacaatcaccctaaagtaa

SEQ ID NO: 854 - protein, 400 aa, Arabidopsis thaliana
  G2840,Z-C2H2 domain coordinates 246-266,297-328,335-356
MPTLYKKAGFKGTNSVDWIPQARFFIYMHIHMMNRDEHIAKKVEGSISSFSGETSTSSKQIYVNPVTTTGTKSMEDDDVSLSLLYNLSTLHEKVHQIQSLVSFYMVSTNNINQSSGSTSLAVANIGSLVQEIITAASSMLYTCQQLQIGSNNNNNDIDNDQTVDAMVLEFSRQETDPGHDFVQESTNLFGVQERGQISFPDQNLDWYNTETINPKKDKHRSKPSSGSYDILELDVADLLAKYTHYCQICGKGFKRDANLRMHMRAHGDEYKTREALISPTSQDKKGGYSLKKHYYSCPQHGCRWNQRHEKFQPLKSVICAKNHYKRSHCPKMYMCRRCSVKHFSVLSDLRTHEKHCGDIKWVCSCGTKFSRKDKLMSHVSLFLGHVPAHGSSKPPTITLK

SEQ ID NO: 855 - DNA, 981 bp, Arabidopsis thaliana
  G2848,family:HLH/MYC
ttaagtaacgacgccgttttcatccaaacacaaacctctggaatcgtgtcaccgttggagctccggcttcattaatggctttcttcaagacctgaagacaaaagaaagtaaaaatatatatacactagagagaccaagatcctcgtttatgggtttcatcgtgtcttgtgcttagggtgacataaatacccatttagagagcttagaccaagaagttttagagtttgtgaagttacttgttggttagtcgaaaaaccgatcatttttgttttgtttgatgacaaggaatggaatactctagagactcggcagagatgatgatggagactaagcgcaatgtctactcgcttgaagataacaaaattaaacgacacaagtcatctgatctctctttctcttccaaggagaggaaagacaaattagcagaacgtatttcagctcttcaacaactagtttccccttacggaaagaccgacactgcatcagttcttctagagggaatgcaatacattcagtttcttcaagaacaagtcaaggttctaagtgctccttatctgcaagcaaccccttctactacagaggaggaagtggaagagtacagcttaagaagtaaagggctatgtcttgttccattggagtatacatcagaagttgctcaaaccaatggtgctgatatttgggctcctgtgaagactccaacatcttctcatgcttttaatctctcgtcttctaattcgccctttcaatgagctgctgctaaattctctgtctcaagactaatgaaaattagccaaagctttggtctgatcatgtattgatggagagaccttgaagtcggtgatggctgtttctgttattttttactgcttaatcccaactctgtggtggcttcttgtaacaattgattctaatgcgaagtttaacggaccggtcaatgaccggaattagcttcctgtttaataaagtttgaattggtgaaaa

SEQ ID NO: 856 - protein, 153 aa, Arabidopsis thaliana
  G2848,HLH/MYC domain coordinates 29-83
MEYSRDSAEMMMETKRNVYSLEDNKIKRHKSSDLSFSSKERKDKLAERISALQQLVSPYGKTDTASVLLEGMQYIQFLQEQVKVLSAPYLQATPSTTEEEVEEYSLRSKGLCLVPLEYTSEVAQTNGADIWAPVKTPTSSHAFNLSSSNSPFQ

SEQ ID NO: 857 - DNA, 776 bp, Arabidopsis thaliana
  G2849,family:HLH/MYC
ttgctctaggatggtaaccttgtaccctatgtaacatgtcttgttagtataaattttgggtcatgttgtgttgatgactctttagcgcatttcttattgacaaaaggtatggaattctctagagacgctggaatgatgatggagaataagcggaatgtctgctctctcggagaaagcagtatcaaacgccacaagtctgatctctctttcagttccaaggagaggaaggacaaggttggagaacgtatttcagctcttcagcaaatagtttccccttatggaaagaccgacactgcatcagttcttctagacgcgatgcattacatagagtttcttcacgaacaagtgaaggtgctaagtgctccgtatctgcaaacggtacctgatgctacgcaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaacagctcatggttggcaatgattgttattattattcgactgcttaatgcatccccttactttggacttgtgtaatatgcccaaacaggaaccaaa

SEQ ID NO: 858 - protein, 149 aa, Arabidopsis thaliana
  G2849,HLH/MYC domain coordinates 28-81
MEFSRDAGMMMENKRNVCSLGESSIKRHKSDLSFSSKERKDKVGERISALQQIVSPYGKTDTASVLLDAMHYIEFLHEQVKVLSAPYLQTVPDATQEELEQYSLRNRGLCLVPMENTVGVAQSNGADIWAPVKTPLSPAFSVTSQSPFR

SEQ ID NO: 859 - DNA, 1766 bp, Arabidopsis thaliana
  G285,family:MISC
tagagatccaaaacctcacaaatttcgaccgagttttgttgaattccgattagatctttcttccacgaaacccccccaagtacccattccatcttctccggtgagtctcccatgttggcattacgctagggttcttcttctctgtggtttcgcataacccaataatccaattttctacttgggcatcaatgggtcgctctcgagggaacttccaaaatttcgaagaccctactcagagaacgaggaaaaagaaaaatgcggctaatgtggagaactttgagtctacttctttggtaccaggtgctgagggaggagggaagtataactgcgattattgccagaaagacattactggaaaaattaggataaagtgtgctgtctgtccagattttgatctctgtatagaatgtatgtctgttggagcagagatcactcctcacaaatgtgatcacccataccgagttatgggaaatctaactttcccgcttatttgtcctgactggagtgcggatgatgaaatgcttctcctggagggacttgaaatttatggcttgggaaactgggcagaggttgcggagcacgtgggaacgaagagtaaagaacagtgtcttgagcactacagaaacatctatttgaactcaccatttttcccacttccggatatgtcacatgtagcagggaagaacagaaaagaacttcaagccatggctaaaggacgcattgatgacaagaaagagcagaacatgaaagaagagcacccgttctctcctcctaaagtcaaagttgaagacacacaaaaagagtcttttgtagacagaagttttggagggaagaaacctgtttccacctcggtaaacaactctttggttgagctgagtaattacaaccagaaaagagaagagtttgaccctgaatatgacaatgatgctgagcaactcttggcggagatggagttcaaagagaacgatactcctgaagaacatgaactgaagctgcgtgtgttgcgtatctattcaaaaaggcttgatgagaggaaacgtagaaaagaattcataatagaaagaaacctgttgtacccaaatccctttgagaaggacctgtctcaggaggagaaagtacaatgccgacgtttggacgtttttatgcgttttcattcaaaagaggagcacgacgagctactccgtaatgttgtaagcgagtaccgcatggtgaaacggctcaaagatctcaaggaagctcaagtggcagggtgtcgttcaacggctgaagcagagaggtatctgggaaggaagaggaagagagaaaacgaagaagggatgaacagagggaaagagagcggtcaatttggtcaaattgcaggggagatgggctctagaccacctgtgcaagcttcttcaagctatgtgaatgatttggacttgattgggttcacggagtcgcaactgctgtctgaatccgaaagcgtctctgcagcgaggtcaagttggttccaccggtttatctacagatgcaacaagtgatgtcacatgagatattcaaagggaatgtaccgaagaagtcggatgcatatagccttttcaagattgatccaaccaaagtggatcgagtttatgatatgcttgtgaagaagggtattgctcaactttaaggcttgtgtagtgttgtatcatatatataaatgtgtgagctctaatgagttatttgttgacattcccttgtttattacaccttgtcaaaattagtttgtaatagaaaaacgattacgg

SEQ ID NO: 860 - protein, 443 aa, Arabidopsis thaliana
  G285,MISC domain coordinates NA
MGRSRGNFQNFEDPTQRTRKKKNAANVENFESTSLVPGAEGGGKYNCDYCQKDITGKIRIKCAVCPDFDLCIECMSVGAEITPHKCDHPYRVMGNLTFPLICPDWSADDEMLLLEGLEIYGLGNWAEVAEHVGTKSKEQCLEHYRNIYLNSPFFPLPDMSHVAGKNRKELQAMAKGRIDDKKEQNMKEEHPFSPPKVKVEDTQKESFVDRSFGGKKPVSTSVNNSLVELSNYNQKREEFDPEYDNDAEQLLAEMEFKENDTPEEHELKLRVLRIYSKRLDERKRRKEFIIERNLLYPNPFEKDLSQEEKVQCRRLDVFMRFHSKEEHDELLRNVVSEYRMVKRLKDLKEAQVAGCRSTAEAERYLGRKRKRENEEGMNRGKESGQFGQIAGEMGSRPPVQASSSYVNDLDLIGFTESQLLSESESVSAARSSWFHRFIYRCNK

SEQ ID NO: 861 - DNA, 1633 bp, Arabidopsis thaliana
  G2855,family:ACBF-like
attaccagagctcaacgagctctcactttctttacgcacacttgttggaacgaaatatattcatagagaagaagaatctcgaaactcttgaatctaaaacaactcggagactctgttttccctttccggagatcagatcggatcaagatgcagacaaccaacggctcagattcgacgttggcaacttccggagccacaccgccgaatcaacaaacccctcctccacctcagcagtggcagcagcagcaacagcaacagcaacagtggatggctgccatgcaatatccaccagcggcggcgatgatgatgatgcagcagcaacagatgctgatgtatcctcatcaatatgttccgtataatcaaggtccttatcagcagcatcatcctcagcttcaccaatacgggtcttatcaacagcaccagcaccagcaacacaaggctattgaccgtggatctggagatgatgtcaagactctttgggttggtgatcttcttcattggatggatgagacttatctccattcttgcttttctcacaccggcgaggtttcttctgtgaaagttatacgtaacaagctcacttctcaatcagaagggtatgggtttgttgagtttctttcacgtgctgcagctgaagaagttcttcagaactatagtggttcagtgatgccaaactcggaccaacccttccgtataaactgggcatcttttagtactggtgaaaaaagagcagtggaaaatggtccagacctatctgtttttgtgggagacttgtctccagatgtcactgacgttttattgcatgagaccttttctgatagatatccttctgtcaaaagcgccaaagttgtgattgattccaacaccggccggtccaaaggttatggttttgtgaggttcggtgatgaaaatgagaggtcaagggctttgacagaaatgaatggagcttactgttcgaacaggcaaatgcgtgtaggtattgcaactcccaaaagagcgattgctaatcagcaacaacattcttcacaagctgtgattctggctggtggacatggatcaaatggttccatgggttatggctcgcagtctgatggcgaatcaactaacgcaacaatatttgttggcggcattgaccctgatgttattgatgaagacctcagacaacctttttcccagtttggagaggttgtttcagtgaagatcccagtagggaaaggatgtggatttgtccaatttgctgacaggaagagtgctgaagatgctatcgagagtttgaacgggacagtcatcggcaagaacactgtcagactctcctggggacgaagcccaaacaagcagtggagaggagactcagggcagcagtggaatggaggatactcacgaggacatggttacaacaatggaggaggatatgctaaccaccacgactccaacaactatcatggggagaattgaagagactcatcaagtgatcatcttcatcatggtttcacatatcaaagctaaaacctgtagtcgaaagaagaattttgttagatggatttgattttgatagacttgttgtttggaggagattcaaaaattttggttactggtttgtctcagactaatataaatggttgcaacttgttgg

SEQ ID NO: 862 - protein, 435 aa, Arabidopsis thaliana
  G2855,ACBF-like domain coordinates 105-285
MQTTNGSDSTLATSGATPPNQQTPPPPQQWQQQQQQQQQWMAAMQYPPAAAMMMMQQQQMLMYPHQYVPYNQGPYQQHHPQLHQYGSYQQHQHQQHKAIDRGSGDDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAIANQQQHSSQAVILAGGHGSNGSMGYGSQSDGESTNATIFVGGIDPDVIDEDLRQPFSQFGEVVSVKIPVGKGCGFVQFADRKSAEDAIESLNGTVIGKNTVRLSWGRSPNKQWRGDSGQQWNGGYSRGHGYNNGGGYANHHDSNNYHGEN

SEQ ID NO: 863 - DNA, 1533 bp, Arabidopsis thaliana
  G2856,family:ACBF-like
gggatatttggcgagccgacccgtcgcgtcgtgggtttaggtttaacgtattggcgcgccagtgaagaaaatagacgacgatggcgatgatgcatcctccgcagccgccgcaaggctcctatcaccatcctcagacgctcgaagaagttcgaactctttggattggtgatttgcagtactgggtcgacgaaaattacctcacttcctgcttctcccaaaccggcgagctcgtttctgtcaaggtaatacgtaacaagatcacgggacagccagaggggtatggttttatagagtttatatctcatgcagcagcagagagaactctgcagacgtacaatgggacacagatgcctggaactgagttaacttttcggttaaattgggcttcttttggttcaggacagaaagttgatgctggacctgatcattctatctttgttggagatttagcacctgatgttacagattatcttcttcaagagacattccgtgttcattattcttctgttagaggtgccaaggttgttactgatccaagtactggacgatcaaagggttatggatttgtaaaatttgcagaggaaagtgaaaggaatcgggctatggctgaaatgaatggtttgtattgctcaacaaggcctatgcgtattagcgcagcaacacctaaaaaaaacgtcggtgtgcagcaacaatatgtcaccaaagctgtttacccagttacagtcccatctgcagttgctgcaccagtccaagcatacgttgctccacctgaaagtgatgtcacctgtacaacgatttcagttgccaatttggaccaaaatgttacagaggaagagctgaagaaagcattctcccaattaggagaggttatttatgtcaaaatacctgcaacaaagggatatggttatgttcaattcaaaaccaggccttctgcagaagaagctgttcaaagaatgcagggacaagtgattggtcaacaagcagttcgcatctcttggagtaaaaatccaggacaggatggttgggttacacaagcagatccgaatcagtggaatgggtattatggttatgggcaaggctatgatgcatatgcttatggggcaactcaagatccatccgtgtacgcatatggtggatatggctatccccagtatccgcaacagggagagggtacacaagacatttcgaactctgcggcgggtggagtagcaggtgcagagcaagagttgtatgatcctctggccactcctgatgtagacaagttaaatgctgcttacctttcggttcatgcaagtgccatattaggaaggccaatgtggcagcggacctcatcgctcacatcacaattgggcaaatgatcgggaagagaagaataaaatggtgggtgctttgagatgtttagtgtgtccatttcactgctctttgtctgattgtttgggatttttctgtaatctacagttaggatctagttacaatgcaaaatcatgaatcttccaacttttctgccatggtcaatgataatgccttttactt

SEQ ID NO: 864 - protein, 425 aa, Arabidopsis thaliana
  G2856,ACBF-like domain coordinates 25-335
MAMMHPPQPPQGSYHHPQTLEEVRTLWIGDLQYWVDENYLTSCFSQTGELVSVKVIRNKITGQPEGYGFIEFISHAAAERTLQTYNGTQMPGTELTFRLNWASFGSGQKVDAGPDHSIFVGDLAPDVTDYLLQETFRVHYSSVRGAKVVTDPSTGRSKGYGFVKFAEESERNRAMAEMNGLYCSTRPMRISAATPKKNVGVQQQYVTKAVYPVTVPSAVAAPVQAYVAPPESDVTCTTISVANLDQNVTEEELKKAFSQLGEVIYVKIPATKGYGYVQFKTRPSAEEAVQRMQGQVIGQQAVRISWSKNPGQDGWVTQADPNQWNGYYGYGQGYDAYAYGATQDPSVYAYGGYGYPQYPQQGEGTQDISNSAAGGVAGAEQELYDPLATPDVDKLNAAYLSVHASAILGRPMWQRTSSLTSQLGK

SEQ ID NO: 865 - DNA, 2956 bp, Arabidopsis thaliana
  G286,family:ENBP
tgcaatttctctcgaccaaaaccctaatttcaggtttggggttttccttctttcactgtcaattttgatgaaacttgtgattcagtgattagaatgaatgctaatgagcaaactcgatccgccaatggcattggcaatggcaatggtgagtctattcccgggattccagatgacttacggtgcaagagatcggatggtaaacagtggagatgcactgcaatgtccatggctgataagactgtttgtgagaagcactacatccaagcaaagaagcgggcggctaattctgctttcagggcgaaccagaagaaagcgaaaaggcgatcatcgttaggcgaaacagatacgtattcggaagggaagatggatgatttcgagttaccagtcaccagcattgaccactataataacggtcttgcctctgcttccaagagtaatggtagactagagaagagacataataaaagcctgatgcggtactcgcccgagacaccgatgatgaggagtttctctccacgtgttgcagtggatttgaatgatgacttgggtagagatgttgtaatgtttgaagagggctacagatcttataggacaccaccatctgttgctgttatggatccgacacgaaacagatcacaccaaagcaccagtcctatggaatactcagcagcaagcacagatgtgtctgcagagtctttgggggaaatctgccatcaatgccagagaaaagatagagagagaatcatttcttgcctcaaatgcaatcaaagagccttctgccacaattgtctatcggcaaggtactcggagatatcacttgaagaagtcgagaaagtttgccctgcatgtcgtggcttgtgtgattgcaaatcttgcctgcgttcagataatacaataaaggttcggatccgggaaatacccgttttggacaagttgcagtatctttatcgtctattatcagctgtcctaccagtcataaagcagatccatcttgaacaatgtatggaagttgaactagagaagaggcttcttgaagttgagattgatcttgtcagggcaagattgaaagcagatgagcagatgtgctgcaacgtgtgtcggataccagttgttgactactaccgtcactgtccgaactgctcatatgacctttgcctgagatgctgtcaagatctacgggaagagtcttcagtgacgattagtgggactaaccaaaacgtacaagatagaaaaggagctcccaaactaaaactaaacttttcatacaagtttcctgagtgggaagccaacggtgatgggagcatcccttgccctcctaaggagtatggaggctgcggttcacattctttgaatcttgcccgcattttcaagatgaattgggttgcaaagcttgtgaaaaatgctgaggagattgttagtggctgcaaattatctgatcttctgaaccctgatatgtgtgattcaagattctgcaaatttgctgagagagaagagagcggtgacaactacgtgtacagcccgtcgcttgaaacgattaaaactgatggagtagctaagtttgagcaacaatgggcagagggtcggcttgttactgtgaaaatggtacttgatgactcatcttgctctagatgggatcctgagactatttggagggatatagacgagctttcggacgagaaactgagagaacatgatccattcttgaaggccattaattgcttggatggtttagaggttgatgtaagacttggggagtttacaagagcatataaagatggaaagaaccaagagacaggtcttccgctattgtggaagttaaaggactggccgagcccaagtgcttccgaggagttcattttctaccaaagacctgagtttatcagaagttttccgtttctcgagtacattcatccccggttaggccttctgaatgttgcagccaagttacctcattactcgctccaaaacgattcaggtccaaagatttatgtgtcttgtgggacgtaccaagaaatcagtgctggcgattcattgactggtattcactacaacatgcgtgacatggtatacctattggtgcacacgtctgaagaaacaacattcgaaagggtgagaaaaacaaaacctgttccagaggaacctgaccagaagatgagcgaaaatgagtcacttcttagccctgagcagaaattaagggacggagagttacatgatctatcacttggtgaagccagtatggagaagaatgaacctgagttggcgttgactgtgaatccagagaacttaacggaaaacggtgacaacatggaatcttcttgcacatcttcatgtgcaggaggagcccagtgggatgtctttcgacgccaagacgtcccaaagttgtccgggtatttgcagagaacattccagaagcctgataatatccagactgattttgtaagccgtacctgctaattcaaataaatgaagtgtgtaaagtcttgtatgtggaatgattgagtttcctagtttgtttactctggtttcaggtgtcacgcccgttgtatgaaggattgtctttaaatgaacaccacaagagacaactaagagacgagtttggagttgagccatggacatttgagcaacatcgtggtgaggctatcttcattccggctggatgtccgttccaaatcactaatcttcagtcgaatattcaggtggcacttgacttcttgtgccctgaaagcgttggagagtcagcaagactagctgaagaaatccggtgtttaccaaacgaccacgaggcaaaacttcagattctagagattggaaagatatcattatacgcagctagctcagccattaaagaggttcagaaactggtcttggatccaaagtttggagcagagcttggatttgaagactctaacttaaccaaagcagtctctcacaacttagacgaggcaaccaagcggcc

SEQ ID NO: 866 - protein, 786 aa, Arabidopsis thaliana
  G286,ENBP domain coordinates 206-252,332-409,588-786
MNANEQTRSANGIGNGNGESIPGIPDDLRCKRSDGKQWRCTAMSMADKTVCEKHYIQAKKRAANSAFRANQKKAKRRSSLGETDTYSEGKMDDFELPVTSIDHYNNGLASASKSNGRLEKRHNKSLMRYSPETPMMRSFSPRVAVDLNDDLGRDVVMFEEGYRSYRTPPSVAVMDPTRNRSHQSTSPMEYSAASTDVSAESLGEICHQCQRKDRERIISCLKCNQRAFCHNCLSARYSEISLEEVEKVCPACRGLCDCKSCLRSDNTIKVRIREIPVLDKLQYLYRLLSAVLPVIKQIHLEQCMEVELEKRLLEVEIDLVRARLKADEQMCCNVCRIPVVDYYRHCPNCSYDLCLRCCQDLREESSVTISGTNQNVQDRKGAPKLKLNFSYKFPEWEANGDGSIPCPPKEYGGCGSHSLNLARIFKMNWVAKLVKNAEEIVSGCKLSDLLNPDMCDSRFCKFAEREESGDNYVYSPSLETIKTDGVAKFEQQWAEGRLVTVKMVLDDSSCSRWDPETIWRDIDELSDEKLREHDPFLKAINCLDGLEVDVRLGEFTRAYKDGKNQETGLPLLWKLKDWPSPSASEEFIFYQRPEFIRSFPFLEYIHPRLGLLNVAAKLPHYSLQNDSGPKIYVSCGTYQEISAGDSLTGIHYNMRDMVYLLVHTSEETTFERVRKTKPVPEEPDQKMSENESLLSPEQKLRDGELHDLSLGEASMEKNEPELALTVNPENLTENGDNMESSCTSSCAGGAQWDVFRRQDVPKLSGYLQRTFQKPDNIQTDFVSRTC

SEQ ID NO: 867 - DNA, 2267 bp, Arabidopsis thaliana
  G2876,family:AKR
tttcgtcccttcactctcttcacatcaaattccgcaccaccacatccacgtgtctcaacctccactctcctacgtctctccaccgtcgccggcgtctgcagcgtctgcttcatcaattcctcgccgtctctctgaaagaaaaaaaggaaccacctttctctctctgttttgctcgatctgttgtaatttactctgtagcgatcatcagatcgccggcgttttaaaccgccatgaaactctccgacgttggattagacgttgtcaaaactccgagattggttaaattgattgcgtttgcgtttctctcaatctcaacaatttttctcttcaatcacttctcagattccttctcttatccatctcttccttttcccatctcctcttcttcaaacgtcaccgaagctattcaaaccaacataacatccgtcgcggcggtggcaccatctcctccaccgcgtcctcgtctcaaaatatcacctcctccgcttccaccgacagtggtgagaacaggtatcatcaacgagaatggtgccatgtctgattccttcgaaatcggcggattcgatccagattccatcgacgagcttaaatcagccaccggaaattcgtcggttgaggaaaaagaatcgccggaagtcggttttcagattgagaaactcaaattgtgtgacaagacgaagatagattacattccttgcttagacaacgaagaagagataaagagattgaacaatacagatcgaggagaaaattacgagagacattgtcctaaacagagcttagattgcttgattccacctccagatggttataagaaaccaatccaatggccacagagcagagacaagatatggttcaataatgtgcctcatacacgtttagtggaagataaaggaggtcaaaattggattagaagagagaaagataagtttgttttccctggaggtggaactcaattcatccatggagctgatcagtacttagaccagatctcccagatgattcctgatattacatttggatcacgcacccgtgttgctttggacattggctgtggtgtggcgagctttggtgcgtttttgatgcagcgtaacacgacaaccttgtctgtagcaccaaaagatgttcatgagaatcagatacagtttgcattggagcgtggtgttcctgcgatggtggctgtctttgccacacggaggttgttgtatccaagccagtcttttgagatgattcattgttccagatgcagaattaattggacacgcgatgatgggatacttcttcttgaagttaatagaatgcttagagcaggaggctactttgtttgggctgcacaacccgtttacaaacatgaggataacttgcaagagcagtggaaagaaatgttagaccttacgaatcgaatctgttgggagcttatcaagaaagagggatatattgctgtgtggaggaagcctctaaacaacagctgctatgtcagtcgcgaagctggaacaaaacctcctttgtgcagacctgatgatgatcctgatgatgtttggtatgtagatatgaaaccgtgcatcacccgattacctgataatggctatggggctaatgtctccacatggcctgcacgtcttcatgatccgccagagaggctacaaagcattcaaatggatgcgtacatatcccgaaaggaaattatgaaggcagagtctagattttggttagaagtagtagagagttatgtgcgggttttccgctggaaggagttcaaactgaggaatgttctggacatgagagctggttttggagggtttgcagcagcattaaacgatctggggcttgactgttgggttatgaacattgttcccgttagcggattcaacaccttgccagttatttatgaccgtggactacaaggggctatgcacgactggtgtgagccatttgacacctacccaagaacctatgatctgatacatgctgcatttctcttctctgttgagaaaaagaggtgcaacataacaaacattatgctggagatggaccggatgttgagaccaggaggacatgtttacataagggattcactgtctttgatggaccaacttcagcaagtggctaaagccatcggttggactgctggtgttcatgataccggggaaggaccccacgcaagcgttaggattctcatctgcgataaacggatatgaggaaaagaaaaagaaaagatacgaaatcgaatgtgatgataagtctgctcaaagcgacagttcttctta

SEQ ID NO: 868 - protein, 655 aa, Arabidopsis thaliana
  G2876,AKR domain coordinates 152-653
MKLSDVGLDVVKTPRLVKLIAFAFLSISTIFLFNHFSDSFSYPSLPFPISSSSNVTEAIQTNITSVAAVAPSPPPRPRLKISPPPLPPTVVRTGIINENGAMSDSFEIGGFDPDSIDELKSATGNSSVEEKESPEVGFQIEKLKLCDKTKIDYIPCLDNEEEIKRLNNTDRGENYERHCPKQSLDCLIPPPDGYKKPIQWPQSRDKIWFNNVPHTRLVEDKGGQNWIRREKDKFVFPGGGTQFIHGADQYLDQISQMIPDITFGSRTRVALDIGCGVASFGAFLMQRNTTTLSVAPKDVHENQIQFALERGVPAMVAVFATRRLLYPSQSFEMIHCSRCRINWTRDDGILLLEVNRMLRAGGYFVWAAQPVYKHEDNLQEQWKEMLDLTNRICWELIKKEGYIAVWRKPLNNSCYVSREAGTKPPLCRPDDDPDDVWYVDMKPCITRLPDNGYGANVSTWPARLHDPPERLQSIQMDAYISRKEIMKAESRFWLEVVESYVRVFRWKEFKLRNVLDMRAGFGGFAAALNDLGLDCWVMNIVPVSGFNTLPVIYDRGLQGAMHDWCEPFDTYPRTYDLIHAAFLFSVEKKRCNITNIMLEMDRMLRPGGHVYIRDSLSLMDQLQQVAKAIGWTAGVHDTGEGPHASVRILICDKRI

SEQ ID NO: 869 - DNA, 2627 bp, Arabidopsis thaliana
  G288,family:MISC
gtcgattgagcagagtaatttattccttattcttcttcttcttcttcaaatcgtgtttctccatttcaaaatccagaaactttgtgattccacggtagttagttccaatctcaatgtctacggcggcagcggctcgtccggtggctggaactggcttacgggagaagacggcagcgtcactggtcaattccttccgattagcgtcggtgactcaacgtttacgttaccacattcaagacggagctaaggttgatcctaaggagtttcaaatctgttgcatctctttcgctaaaggcattgattttgctatagcgaataatgatattcctaagaaggttgaggagtttccgtggttactcaaacagttgtgcagacatggaactgatgtgtacactaagacggcgcttatggtgctgatgatctctgttaagcatgcttgtcatttgggatggttttcggatagcgagagtcaagaacttatcgctctagctgatgagataaggacttgttttgggagttctggaagcactagccctggtatcaaaagtcctggcagtacattttcgcagatcatggagaggttctatccatttgtaaagcttgggcatgttcttgtttcttttgaagtgaaggctggctatacaatgctggcgcatgatttttatatctcaaagaatatgccacattcactccaagagaaaattcggttatttgttgcccagacagacaacatagacacgtctgcctgtatttcaaatcctccagaagtcagcttcttgctaaatggaaagggggttgagaagagagtcaatatcgcaatggatacagggcctcaactccctacaaatgttactgcacagctgaaatatggaactaatcttctccaagtgatggggaattttaaaggaaattacatcatcataattgcttttacgggactggtagtgccacctgaaaaaccggttcttaaagattaccttcagtccggagtcattgaagcaagtccagattcagacatcattgaggggccatcacgagtatctctcagttgccctataagtcgcaagcggatcaagctaccagtcaagggccagttatgtaaacatcttcagtgttttgatttctcaaactacgttcacataaatatgaggaacccaacctggcgctgcccgcattgcaatcaacctgtttgctaccctgacattcgtttagatcaaaacatggccaagatattaaaagatgtggaacacaatgctgctgatgtaatcatcgatgctggtggtacatggaaggttacaaaaaatactggcgagaccccggaacctgtgcgtgagatcattcatgatctagaagacccgatgagcttattaaactctggtcctgttgttttcgatcttacgggggatgatgatgctgaactggaagtttttggtgacaacaaggttgaggaccggaagccctgtatgtctgatgctcagggtcaatctaataataacaacacaaataaacatccttcaaacgatgattactcttcgatatttgatatctctgatgtgatcgcacttgacccggagattttatctgctttgggaaacactgcgccacaaccgcatcaagcttcgaatactggaactggtcaacaatattcaaacttatcccaaataccaatgtccatagatccaatgccggtacctgtaccattctcgcagacaccatctccaagagatagaccagcaactacttccactgtcttcaccataccgaatccctctccacaatactctcaggttcatgcttcacctgttacacccaccggaacatatcttggtagaaccactagtccgagatggaaccagacttatcaatctcaagcgccaccaatgacaactccatatacgagccggaaggtctcagttccagtaacgagccagtcgccagcgaatgtatcctcttttgttcagtctcagcatgtccctagagtactcagccagcctaataattatggcgtcagaggtttaaccagtagccatgcaagcacttcaaggcagcacccaagtggtcccactgttcaatctgtttctcgattaagtgacctagtggatgtagacttgacggttcctgatacatccaactggcgcccgaggatgcgaggaagtcttgtgcccggttctcattccactgctcttgaccacatgatcatccgacctagccaacagtctcaaacttccactaggctgaatagttcacagccggttcagacaccatcggttcaaacgtctcaagctcagtcaccttttacaacggctgcctatagaaccgagacagttttaggaaaccgaaaccatccggtgcccgctcctcctggcattgttaggcctactggaccgacatcttgatggagaacttgagaggctagaacaaggggaagttggtacttaggagttaggacacaacacttaacataataaattagtaactttatcactttcccacgccatgaacagagtttaggattccggtgcgcaagtcgtattctgtttatgagggattagtttgtatttagcttgctgttaacttgtaatgacgatcaaactataagtgttatcaattactcttgtacccaaaaa

SEQ ID NO: 870 - protein, 760 aa, Arabidopsis thaliana
  G288,MISC domain coordinates 309-361
MSTAAAARPVAGTGLREKTAASLVNSFRLASVTQRLRYHIQDGAKVDPKEFQICCISFAKGIDFAIANNDIPKKVEEFPWLLKQLCRHGTDVYTKTALMVLMISVKHACHLGWFSDSESQELIALADEIRTCFGSSGSTSPGIKSPGSTFSQIMERFYPFVKLGHVLVSFEVKAGYTMLAHDFYISKNMPHSLQEKIRLFVAQTDNIDTSACISNPPEVSFLLNGKGVEKRVNIAMDTGPQLPTNVTAQLKYGTNLLQVMGNFKGNYIIIIAFTGLVVPPEKPVLKDYLQSGVIEASPDSDIIEGPSRVSLSCPISRKRIKLPVKGQLCKHLQCFDFSNYVHINMRNPTWRCPHCNQPVCYPDIRLDQNMAKILKDVEHNAADVIIDAGGTWKVTKNTGETPEPVREIIHDLEDPMSLLNSGPVVFDLTGDDDAELEVFGDNKVEDRKPCMSDAQGQSNNNNTNKHPSNDDYSSIFDISDVIALDPEILSALGNTAPQPHQASNTGTGQQYSNLSQIPMSIDPMPVPVPFSQTPSPRDRPATTSTVFTIPNPSPQYSQVHASPVTPTGTYLGRTTSPRWNQTYQSQAPPMTTPYTSRKVSVPVTSQSPANVSSFVQSQHVPRVLSQPNNYGVRGLTSSHASTSRQHPSGPTVQSVSRLSDLVDVDLTVPDTSNWRPRMRGSLVPGSHSTALDHMIIRPSQQSQTSTRLNSSQPVQTPSVQTSQAQSPFTTAAYRTETVLGNRNHPVPAPPGIVRPTGPTS

SEQ ID NO: 871 - DNA, 2152 bp, Arabidopsis thaliana
  G2885,family:GARP
agagtacgcgggggtactatattcctttgaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatgtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcactcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacaaggctgttcccaaaaaaatacttgatctcatgagtatagaaggtctcactagggaaaacgtagccagtcatttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggaggagaataacggaatggtgccagtggctactagatttggctttgattcatttcctccaccttagctagtcatctctttctctaccagttgcattaagtttctccacttgagaccattttcatgtgatttttttaaatttcttcccacattgtttcctccgactgtcaatagatcatagtacaccaacctgtttcatactctcttttatgaattggaattgaaagcgagcctgttacaaaaaaaaaaaaaaaaaa

SEQ ID NO: 872 - protein, 632 aa, Arabidopsis thaliana
  G2885,GARP domain coordinates 196-243
MEFGSTEDGRHDKFPVGMRVLAVDDNPTCLRKLEELLLRCKYHVTKTMESRKALEMLRENSNMFDLVISDVEMPDTDGFKLLEIGLEMDLPVITHSDYDSVMKGIIHGACDYLVKPVGLKELQNIWHHVVKKNIKSYAKLLPPSESDSVPSASRKRKDKVNDSGDEDDSDREEDDGEGSEQDGDGSGTRKKPRVVWSQELHQKFVSAVQQLGLDKAVPKKILDLMSIEGLTRENVASHLQKYRLYLKKIDEGQQQNMTPDAFGTRDSSYFQMAQLDGLRDFTAARQIPSSGLLSRSHLTKLQPPMYSSINLQGMNSSSFIQQGHHQNSSNSANPFGTYHSTLSPRIQNVNLFQRTSSPLEPLQFPRSKSYIGDFKGLGDRAIGGSFLDTCMPFGSSSTSLPSASTNPLMLQANYTQPLHIASDGIQPCIEGTPSNSASPNISFQGLSRFPGHSWQGNLNTTRFPPSSLPLNLAFLPDQVTCAGNNLGDCTSLVSAENPGGEMQCDPQLLGGFMQNVNPLGGQKWEQQNCTMLNNPFGNIEYPLPADNMVFRDNNSTRSKGLDESLMNPIDNSQEYVGKATTMLDPEMKSGKPENDNQHDVFDDIMNEMMKQEENNGMVPVATRFGFDSFPPP

SEQ ID NO: 873 - DNA, 1470 bp, Arabidopsis thaliana
  G2887,family:NAC
atggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctgatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaa

SEQ ID NO: 874 - protein, 489 aa, Arabidopsis thaliana
  G2887,NAC domain coordinates 4-180
MGKTQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEEVRTDVPSTSNPTNLLEPSKETTLALTAPDDSNKDCFGGMISESCVSDFLPATTNTTSELPHPSDAATTPMSTAPLAETVQTPNNDDLYSMLDLFDDDEEFLGFNNNEVRYDPGVSAPVCLEEEGIFNGLPELSSMPRTASYDLVENSELYLELQDLTAPLNPQTGLQDLTAPFNPQTGLQDLTAPFNHQTGLQDHTAPFNPQTGLQDHTAPFNHQTGLQDLTAPFNPQTGLQDLTAPFNPQTGLHDLTSPFNPQTGLQDLTAPLNPQTGNRNDPRSSSFLYNQGHFDFSGGNDDDPYGFSASMRHRPKM

SEQ ID NO: 875 - DNA, 1917 bp, Arabidopsis thaliana
  G2891,family:AKR
caagcgtgcgagagttgaagaagaggaaggattgttttaagagcaagaaaggaatttgaaaaccatgggaggaggttatgtgttgtttggttcggctagatcggggcagatgataatggtggctctggtcctaatggttggatcattttacgcaggctctatcttcggaaacaattcacctatttacatttcccaaccttcttcttccaattcttcttcttcttctccatcacaatctggtccatcaaattttgctaacaaaatagagctcacttaccggagaacttctgtttcgatccctgagagtggggtgaatgtttgtccattgaagttcaatgagtatataccttgtcacaatgtcacgtatgtgcaacagcttctcccaagcttgaatctttctagaagagaagagcttgagagacactgtccgccactcgaacagcgtctgttttgtttggttcctccgcctaaagattataagataccaatacgctggccgactagcagagattatgtatggagaagcaatgtgaatcatacgcatcttgctgaagtgaaaggcggccaaaattgggtgcatgaacaaggtcagttatggtggttccctggtggtggtactcatttcaaacatggagctccggaatacatccagaggttaggaaacatgacaactaatgaaacaggtgaccttctttcagctggggttgaacaagttcttgatgttggatgtggagttgctagctttgcagcttatcttcttcctttaggtataaagacaatgtcttttgcccctaaagatggtcatgaaaaccaaatccagtttgcattggagagaggaatccgcgcaatgatctctgccatagccaccaaacaaatgccatatcccgcggcctcgtttgatatggttcactgttcaagatgtcgtgttgattggcatgaaaatgatggtgtcttgatgaaagaggttaatcgtcttctccgacccaatggatactttgtttactcggcaccacctgcgtacagaaaggataaagatttccctgtgatttgggataagttggtcaatctaactagcgcaatgtgctggaagctcatttcccgaaaggtacagactgcaatatgggttaaagaagatgacgaggcttgccttaggaagaatgcagagctagagcttataactatatgtggtgtagaagatgtttcgaaagcttcatggaaagttcctcttagagactgtgtggacattagtgaaaatagacaacagaaaccctcttctttaactgaccgtctatcttcatatccaacaagtctaagagaaaaaggcatcagcgaagacgaatttacattggacacaaacttctggagagaacaagtgaatcagtactgggagttgatgaatgttaataagactgaagtgcgaaatgtgatggacacaaatgcattcattggtggatttgccgcagccatgaactcatatcccctttgggtcatgaacgttgtacctgctacaatgaacgataccttatccggaatttaccagaggggcttaaccggtgcttatcatgattggtgtgagccattctcaacatatccccgtacttacgatctgctacacgcggaccatctcttcactcactataaaatctacggtgaaggttgtttactagaggacatcatgcttgagatggaccgcattatacgccctcagggatttatcattatcagagacgaggaatcaatcgtctcaagagtccgagacttggctcctaagttcctttgggaagttgaagcacatgagcttcaagacaaatacaagaagacagaaactgttctattttgcagaaagaaattttgggcaatcctttgaaaaagtccacgtgtagaaattcttttttacttgtcttggttattactaag

SEQ ID NO: 876 - protein, 600 aa, Arabidopsis thaliana
  G2891,AKR domain coordinates 92-594
MGGGYVLFGSARSGQMIMVALVLMVGSFYAGSIFGNNSPIYISQPSSSNSSSSSPSQSGPSNFANKIELTYRRTSVSIPESGVNVCPLKFNEYIPCHNVTYVQQLLPSLNLSRREELERHCPPLEQRLFCLVPPPKDYKIPIRWPTSRDYVWRSNVNHTHLAEVKGGQNWVHEQGQLWWFPGGGTHFKHGAPEYIQRLGNMTTNETGDLLSAGVEQVLDVGCGVASFAAYLLPLGIKTMSFAPKDGHENQIQFALERGIRAMISAIATKQMPYPAASFDMVHCSRCRVDWHENDGVLMKEVNRLLRPNGYFVYSAPPAYRKDKDFPVIWDKLVNLTSAMCWKLISRKVQTAIWVKEDDEACLRKNAELELITICGVEDVSKASWKVPLRDCVDISENRQQKPSSLTDRLSSYPTSLREKGISEDEFTLDTNFWREQVNQYWELMNVNKTEVRNVMDTNAFIGGFAAAMNSYPLWVMNVVPATMNDTLSGIYQRGLTGAYHDWCEPFSTYPRTYDLLHADHLFTHYKIYGEGCLLEDIMLEMDRIIRPQGFIIIRDEESIVSRVRDLAPKFLWEVEAHELQDKYKKTETVLFCRKKFWAIL

SEQ ID NO: 877 - DNA, 1140 bp, Arabidopsis thaliana
  G2893,family:MYB-(R1)R2R3
aaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctgggctaaagagagcaggaaaaagttgtagattgagatggttgaattaccttaaacccgacataaagcgtgggaatctcactcctcaagaacaacttttaatccttgagctccattctaaatggggtaataggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtttatcggtcttttattaaattttgattgttttggattccttaaaaatgtgttcttattatagtttttaatgaaaaaaatgtttaagcgcaaaaaaaaaaaaaaaaaaaaaaaaaaaaaa

SEQ ID NO: 878 - protein, 283 aa, Arabidopsis thaliana
  G2893,MYB-(R1)R2R3 domain coordinates 19-120
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 879 - DNA, 441 bp, Arabidopsis thaliana
  G2896,family:HMG
cctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaagaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatat

SEQ ID NO: 880 - protein, 125 aa, Arabidopsis thaliana
  G2896,HMG domain coordinates 30-102
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 881 - DNA, 456 bp, Arabidopsis thaliana
  G2898,family:HMG
atgacgaagagagctcccaagtcagggcctttgtctccgtcgtgcagcggaggctctagtcggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctggatgatttccggaagcaatatcaagaggagaatccagatgtcaagtccatgcgcgagattgggaagacatgtggagagaaatggaaaacaatgacttacgaggaaaaggtaaagtattatgatatagctactgagaagagggaagaatttcaccgagcaatgacagaatataccaagagaatggaatcaggtgcccacgatgaatcagagaccgactcagactattctgaatag

SEQ ID NO: 882 - protein, 151 aa, Arabidopsis thaliana
  G2898,HMG domain coordinates 59-131
MTKRAPKSGPLSPSCSGGSSRNLELAVKSSEGARRSTRLRLQPLRKPKTSPKKKPVKLQTKMPKKPATAFFFFLDDFRKQYQEENPDVKSMREIGKTCGEKWKTMTYEEKVKYYDIATEKREEFHRAMTEYTKRMESGAHDESETDSDYSE

SEQ ID NO: 883 - DNA, 1025 bp, Arabidopsis thaliana
  G29,family:AP2
cctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgttgtttgaattctatttttctgtttgggtcagcttgttgtatgctgacgtggaattatgctatatcttttgcttattttatgttcacattcgagcaaaatttattcattcgtttatttgttttttaatacaactcttgatatttctaaattctaacc

SEQ ID NO: 884 - protein, 282 aa, Arabidopsis thaliana
  G29,AP2 domain coordinates 134-197
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 885 - DNA, 3684 bp, Arabidopsis thaliana
  G290,family:SWI/SNF
atgagtaagaaggattcagtatttcagtcgcaagcggatgatttctctggtggctttgaatttggagccgacgacgaggattttatgattgacatagaggcgatttatcggattctggatgaaagccctgtttctatggaggttagtcaagaaataatgtctccggttggttcatctgtggtagagtctggcgagtttaggaacacactgatgcaaagtggatctcaggccactggttggtttccttaccgggatttgtatggtcttggagcctcacaaagtgaaatagcagagccaagttcattttctgaccctgagaatggacgattgggactaagtgcgacttgttattctgactacggtggcaatgtggtctcctttcctgtaaattgtgaagatggcactgtatccatcctggatgacatgagaattgaatccaaatttacaccttgcagtcccactacgatgactacctatctcaataacatgcctggaaatgactcaggaattggagccacgcaaaattcttccctgatgtctcatttctcccctaattccagttctattgtggactgtgcctcctctgaaccatatggccaccatacaatggatgcacccttatcagaagtttctcccaatttggttcctggttacgcatttcagttctttcccaagaaagaagaactgctaaatgacttgaagaatgagtttatccactgtcagtcggatggtgcaagccgaatggtttttgatagacatgtaggattcgataacggaacttcagagaggaattctgggcctgatgtaagcagtgaaagagaactcagcctcaaatgtgaaatcattccttcagtttcccctgtctgtgtcaaaccatacaacagttctgatggtcatcaagttgaaaaggagcttgagcagcctgataattgttcaagcagttttcaggagaatagagcagtccatatgaaggttaaaccagagcttgcgttggagaacacggtttacagttcaattcctgggaactatagtagatgtagtgatgttcatacagttggaggaacgacactgccatggtctggtgtctctaattgcgcaatctcctatcagacagatgtcgggaaagaatacccttttatcccacctcagactgctttccctggtcaagatattgacggcaggagcttctatagttgttttgattcagatgactgttttcaaaacgtaacagatcctgacccagaaacatcacgcactgagtctttggattatctggtaggagacgaggaccatgaatatattaagaggacatgctttaatctttctagtttcagctctggaacagttgaaagtctttcatcaaaacgaatacccgaacgagaagatgattctgaaatccataaaatagaatcctatggtgaatttgttaatccacaccaatatctacctgtgcagagaccagtgttttcttcagaacattctacaggtagtcaaactcttaataattgtggaggcttgaagtttgagtcaaacaagggaaacatgaattttcatgcagacttgcaggatctttctcagcatagttctgaagcaagtcctcctgacggtgtcttggcagtgtcgcttcttagacatcagcgtattgcattgtcgtggatgtcccaaaaggagacaagcgggaacccctgttttgggggcattcttgctgatgatcagggacttggaaaaacagtttccacaatagcgcttatactgacagaacggtctacaccttatctaccatgtgaagaagattcaaagaatggaggatgcaatcaatctgatcactctcaagtggttttcaatgaaaacaaagttgtcgaagatagtttatgcaagatgaggggaaggccagctgccggaactcttattgtctgtcccactagtttgatgagacaatgggctgatgaattacgcaagaaggttactcttgaagcacatctctctgtgctggtataccacggttgcagcagaacaaaggatcctcacgagctagctaaatatgatgtcgtcattaccacatattcccttgtgagcaagaggaaacatatggattgtgaacctgttgagtttctgtctggccctctcgcgcaagtttcatggtttagagttgttctagatgaagctcagagcattaagaattacaaaacccaagcttcaatagcatgttcaggccttcatgctaagcgtaggtggtgtttgtctggcactcctatccagaattcaattgctgacctctacagctacttcagatttcttaagtatgatccttattctagctaccaaacgttttgtgaaacgattaagaaccccatcagtagctacccgggggaaggatataaaacgttgcaggctatcctgaaaaaagtaatgcttagacgaactaaagatacacttctcgatggaaaacccgtgatctctttacctccgaagtccatcgagttgaggagagtggactttaccaaggaagaacgtgatttctactcaaaactagagtgcgactctcgtgaccaattcaaggaatatgcagaagctggaacggtgaagcaaaattatgtaaatattttgttgatgctgctgcgtcttcgtcaagcttgtggccaccctcttctagtatccagtttgtcatggtcatcctcagctgaaatggttaagaagcttccatatgagaagctaacctttcttctgcatcgcttagaagcttcactggcaatttgtggtatctgcaatgtaagactctctactcatgctgttgtttcactctgtggtcacgttttctgtaatcagtgcatttgcgaatgtcttactcgcgataataatcaatgcccactgtcatactgcaaagtcggacttgaaatttcatcattattttccagagaaacactggaaaatgctatgcttgacttgcataaacttgatgccccatgtgatcgtaccacttcagatcctgttgggagtggtgagccttgtgaaaatttaccatgtggttcatccaaaatcaaggctgctctagatatcttgcaatcactgagcagaccacagagtcccgcgacagtaatgaatgatgtgaatcagagctccgaaaatggagagaataatcagcagcttgacaagtcattcagtttacctgcaactccagcgaagagtagtgtgggtggtgtggttaatgtagctggagaaaaagccattgtgtttacccaatggacaaagatgctggacctccttgaagctggtcttaagagttcaggtattcagtatagaaggtttgatggaaaaatgacagtaccagctcgagatgcagcagtacaagattttaatactctccctgatgtttctgtaatgataatgtctctcaaagctgctagtcttgggctaaatatggtggcagcttgtcatgttatcatgctggacttatggtggaacccgactacagaagatcaggcaattgacagagcacaccgtattggacagacacgaccagtaaaggtggtgcgcttcacagtaaaagatacagttgaagatcgcatattggccctccagcaaaagaagagaaagatggtggcttctgcattcggagaacatgaaaacggtagtcgagaatcgcatctctctgtggaggatttgaattatctgttcatggcatga

SEQ ID NO: 886 - protein, 1227 aa, Arabidopsis thaliana
  G290,SWI/SNF domain coordinates 538-784,919-958,1086-1169
MSKKDSVFQSQADDFSGGFEFGADDEDFMIDIEAIYRILDESPVSMEVSQEIMSPVGSSVVESGEFRNTLMQSGSQATGWFPYRDLYGLGASQSEIAEPSSFSDPENGRLGLSATCYSDYGGNVVSFPVNCEDGTVSILDDMRIESKFTPCSPTTMTTYLNNMPGNDSGIGATQNSSLMSHFSPNSSSIVDCASSEPYGHHTMDAPLSEVSPNLVPGYAFQFFPKKEELLNDLKNEFIHCQSDGASRMVFDRHVGFDNGTSERNSGPDVSSERELSLKCEIIPSVSPVCVKPYNSSDGHQVEKELEQPDNCSSSFQENRAVHMKVKPELALENTVYSSIPGNYSRCSDVHTVGGTTLPWSGVSNCAISYQTDVGKEYPFIPPQTAFPGQDIDGRSFYSCFDSDDCFQNVTDPDPETSRTESLDYLVGDEDHEYIKRTCFNLSSFSSGTVESLSSKRIPEREDDSEIHKIESYGEFVNPHQYLPVQRPVFSSEHSTGSQTLNNCGGLKFESNKGNMNFHADLQDLSQHSSEASPPDGVLAVSLLRHQRIALSWMSQKETSGNPCFGGILADDQGLGKTVSTIALILTERSTPYLPCEEDSKNGGCNQSDHSQVVFNENKVVEDSLCKMRGRPAAGTLIVCPTSLMRQWADELRKKVTLEAHLSVLVYHGCSRTKDPHELAKYDVVITTYSLVSKRKHMDCEPVEFLSGPLAQVSWFRVVLDEAQSIKNYKTQASIACSGLHAKRRWCLSGTPIQNSIADLYSYFRFLKYDPYSSYQTFCETIKNPISSYPGEGYKTLQAILKKVMLRRTKDTLLDGKPVISLPPKSIELRRVDFTKEERDFYSKLECDSRDQFKEYAEAGTVKQNYVNILLMLLRLRQACGHPLLVSSLSWSSSAEMVKKLPYEKLTFLLHRLEASLAICGICNVRLSTHAVVSLCGHVFCNQCICECLTRDNNQCPLSYCKVGLEISSLFSRETLENAMLDLHKLDAPCDRTTSDPVGSGEPCENLPCGSSKIKAALDILQSLSRPQSPATVMNDVNQSSENGENNQQLDKSFSLPATPAKSSVGGVVNVAGEKAIVFTQWTKMLDLLEAGLKSSGIQYRRFDGKMTVPARDAAVQDFNTLPDVSVMIMSLKAASLGLNMVAACHVIMLDLWWNPTTEDQAIDRAHRIGQTRPVKVVRFTVKDTVEDRILALQQKKRKMVASAFGEHENGSRESHLSVEDLNYLFMA

SEQ ID NO: 887 - DNA, 1522 bp, Arabidopsis thaliana
  G2902,family:HMG
taataaacccagaggctccactaatcgtcaaaatcccaaattccaaaatctccatttctctctcgctctcgctcaatctctcttcacaatgtcgacagtttcttcagatcctgctcatgcgaagaaatcgagaaacagtagaaaagcgttaaagcaaaagaatgagatcgtcgagtcatcaccggtctcagacaaggggaaagaaacgaagtcgtttgagaaagatctgatggagatgcaagcgatgttggagaagatgaagatcgagaaggagaaaactgaggatttgttgaaggagaaggacgagatcttgaggaagaaggaagttgaacaggaaaaacttaagacggagctgaagaaactgcagaagatgaaggaattcaagcctaacatgacttttgcttttagtcaatctttggcacaaactgaagaagaaaagaagggaaagaagaagaagaaggattgtgctgaaacaaagagaccatcaacaccatatattttgtggtgtaaggataattggaacgaagtgaagaaacagaatcctgaagctgatttcaaggagacttcgaacattctgggtgctaagtggaaggggattagtgctgaagagaagaagccttatgaggagaagtatcaggcggataaggaagcttatcttcaggttattacaaaggagaagcgtgagagggaagcaatgaagcttcttgatgatgagcagaagcagaaaactgcaatggaattgcttgatcagtatcttcactttgttcaggaagctgaacatgacaacaagaaaaaggccaagaagataaaggatcccctgaagcctaaacaaccaatatctgcttacctgatctatgcaaacgagaggagagctgctttaaaaggagaaaacaaaagcgttattgaggtcgctaagatggctggagaagagtggaagaacttgtcggaagaaaaaaaggctccttatgatcagatggcgaaaaagaacaaggagatatatctgcaagaaatggaaggatataaaagaacaaaggaagaagaagcaatgagccagaagaaagaagaagaagaattcatgaaactccataaacaagaagctctccaacttctcaagaagaaggagaaaaccgacaatatcataaagaagacgaaagagacggcgaagaacaagaaaaagaacgagaatgttgatcctaacaaacccaaaaagcctacttcttcatactttctcttctgcaaagacgcaagaaagagtgtgttagaagaacatcctgggatcaacaactcaactgttactgctcacatttcattgaaatggatggaacttggtgaagaggagaaacaagtttacaatagcaaagctgctgagttaatggaagcttacaagaaagaagtggaagagtacaataagaccaagacttcgtcgtagagaaagaaaaattagagaatgttcaagtttgctcatattgaacatctctacttatgcaaaatgactctgctacttaaatcgctaggcgctaat

SEQ ID NO: 888 - protein, 446 aa, Arabidopsis thaliana
  G2902,HMG domain coordinates 128-198,242-311,371-441
MSTVSSDPAHAKKSRNSRKALKQKNEIVESSPVSDKGKETKSFEKDLMEMQAMLEKMKIEKEKTEDLLKEKDEILRKKEVEQEKLKTELKKLQKMKEFKPNMTFAFSQSLAQTEEEKKGKKKKKDCAETKRPSTPYILWCKDNWNEVKKQNPEADFKETSNILGAKWKGISAEEKKPYEEKYQADKEAYLQVITKEKREREAMKLLDDEQKQKTAMELLDQYLHFVQEAEHDNKKKAKKIKDPLKPKQPISAYLIYANERRAALKGENKSVIEVAKMAGEEWKNLSEEKKAPYDQMAKKNKEIYLQEMEGYKRTKEEEAMSQKKEEEEFMKLHKQEALQLLKKKEKTDNIIKKTKETAKNKKKNENVDPNKPKKPTSSYFLFCKDARKSVLEEHPGINNSTVTAHISLKWMELGEEEKQVYNSKAAELMEAYKKEVEEYNKTKTSS

SEQ ID NO: 889 - DNA, 1125 bp, Arabidopsis thaliana
  G2906,family:Z-C2H2
taaagatcccggcgatgttttcaagatttgtcctaaaaagttggagacctaaaacccaaaccacatctctcaattcaatcaaaggttttagctttagctctagctcgataaaccctaaacccaaaatccgagtaggggtttggtgggatctagacaacaaaccaccagcctctttcccgccttacgacgccgccgtcaagctccgaaccgccgcgtcgtctttcggaaccgtgaagctaatgatggcgtatgcgaatcgtcacgcctttagctacgttcctttagaagttcgagaacagaggaaagataggaaattgctaaacaaattagagaacaaaggtttagttaaaccaccggagccttacttctgcggtgtttgtgaccggagattctacactaacgagaagctaattaatcatttcaagcagattcatgagacagagaatcagaaacgtatgagacagattgaatcttcgaaaggacatcgaagagtgagacttgtggctaagtattcgatgaagattgagaagtataaaagagcggcgaggaatgttttgactccgaaggaaggttacggtttagctgatgagctgaaacgagctggtttttgggtgaagatggttagtgataagccagatgctgctgataaggcgttgaaggaacatttggttgaagtgatggataagagagaagtggagtgtgttgttttagtgtctgatgattctgattttgcggggattttgtgggaagctaaggagaggtgtttgaggacggttgtgattggagattcgaacgaaggtgcgctgaagcgagtagcggatgttgcgtattcgtggaaggaagtgacgatggggaaggcgaagaaggaagttgagaaagttgtggggaagtggaaggatagagatgtgttgaagaagttggagtggacttatgatcctgctttggagaaagagagaggtggttcttgcggtgtttgggattacgagtttgattatgatgatgagattgagaatggaacagaggtggaacctgtggagattggtgatggtgttgactggtggaagatcgatactgaagatggtgttggatcttcaagaacttgtcgataacatcatcgcatatgtc

SEQ ID NO: 890 - protein, 364 aa, Arabidopsis thaliana
  G2906,Z-C2H2 domain coordinates 119-140
MFSRFVLKSWRPKTQTTSLNSIKGFSFSSSSINPKPKIRVGVWWDLDNKPPASFPPYDAAVKLRTAASSFGTVKLMMAYANRHAFSYVPLEVREQRKDRKLLNKLENKGLVKPPEPYFCGVCDRRFYTNEKLINHFKQIHETENQKRMRQIESSKGHRRVRLVAKYSMKIEKYKRAARNVLTPKEGYGLADELKRAGFWVKMVSDKPDAADKALKEHLVEVMDKREVECVVLVSDDSDFAGILWEAKERCLRTVVIGDSNEGALKRVADVAYSWKEVTMGKAKKEVEKVVGKWKDRDVLKKLEWTYDPALEKERGGSCGVWDYEFDYDDEIENGTEVEPVEIGDGVDWWKIDTEDGVGSSRTCR

SEQ ID NO: 891 - DNA, 3109 bp, Arabidopsis thaliana
  G2910,family:PCGL
agggttcttcttcatcggatcatcggccgtatctgaaaccggagatggccggcgttgattccggcaagcttatcggctctgagattcatggattccatactttacaagatctagatatacaaacaatgttagatgaagcatacagtaggtggctccgtcctaatgagatccatgctcttctctgtaaccataaattcttcaccatcaacgtcaagcctgtgaacttacccaaaagtggtacgattgtgttgtttgatcgtaagatgttgaggaactttagaaaggatggtcataactggaaaaagaaaaaggatggaaagacaattaaggaagctcatgaacatctaaaagttggtaatgaggaaaggattcatgtttattatgcccacggtgaggatacccctacatttgtgcgaaggtgttactggttattggataagtctcaggagcacatagttcttgtccactatcgcgagacacatgaggttcatgcagctccagcaacacctgggaactcgtactcaagttcgatcactgaccacttatctcctaaaattgtagctgaagataccagttctggtgtccataatacttgtaatacaggttttgaagtgcggagcaacagtctgggttctagaaatcatgagattaggcttcatgagatcaacacacttgattgggatgagcttctagtacctgcagatattagcaaccaatctcatccaaccgaagaagatatgctatacttcacagaacagctccaaactgcacccaggggatctgtaaagcaaggaaatcaccttgcaggctacaacggatcagtagatataccatcattcccgggtcttgaagatcctgtatatcaaaataataactcatgtggtgcaggagaattttctagtcagcattcgcactgtggagtagatccaaatctacagagaagggatttcagtgcaacagttactgatcaaccaggtgatgctttgcttaataacggttatggaagtcaggatagttttggaaggtgggtgaacaacttcattagtgactctcctggttccgtcgatgatccttcccttgaagctgtatatacacctgggcaggattcatctactcctcctactgtatttcattcccactctgacataccggagcaagtattcaacataactgatgtttcacctgcctgggcgtattcgacagagaaaacaaagattcttgtaactgggttctttcacgacagcttccaacatttgggaagatcaaacctcatctgcatatgtggagagttgcgtgtccccgccgaatttctccagatgggggtttatcgttgcttccttcctcctcaatctcctggggtggtgaacctttatcttagtgtcgatggaaacaaaccgatcagccaattgttcagcttcgaacaccgctcagttcagtttatcgaaaaagccatccctcaagacgaccagctatacaagtgggaagaatttgagttccaagtcagacttgctcatcttctgttcacttcttcgaacaaaatcagcgttttaactagtaaaatatcacctgaaaaccttcttgaggctaagaaactcgccagcaggacttcgcatctcttaaatagttgggcttatttaatgaagtcaattcaggcaaatgaggtaccgtttgatcaagcgagggaccatctctttgagcttactctgaaaaataggctgaaagagtggcttttggagaaggtcatcgaaaaccgcaacactaaggaatatgactctaaagggcttggagtgatccacctctgtgccgtcctaggatacacttggtcaatccttctcttctcctgggcaaatatatcgttggatttccgtgataagcagggttggactgctcttcattgggcagcatactatggaagggagaaaatggtggctgctcttctatctgcgggggcaaggccaaacctggtgacagaccctactaaggaattcctcggcggctgcacggcagctgatctggcacaacagaaaggttatgacggtttagcagcttttcttgctgagaaatgtcttgtagcacagttcaaggacatgcaaacggctggaaacattagtggcaaccttgaaaccatcaaggcagagaagtcgtcaaatccagggaatgcaaatgaagaggagcaaagcctgaaggacactctagcggcatacagaactgctgcagaggcagcggcgcggattcagggagcgttcagggagcacgagctgaaagttaggtcaagcgcagttaggtttgctagcaaggaagaagaagccaaaaacataatagccgcgatgaagattcagcacgcgtttcgcaatttcgaggttcgtaggaagattgcagccgctgctcggattcagtataggttccaaacatggaaaatgaggcgggaatttctgaacatgcgaaagaaggcaattaggatccaggctgcgtttagaggtttccaagtaagaagacagtaccagaaaataacatggtcagtgggagttcttgagaaggcaattctgagatggagactgaagagaaaaggattcagaggccttcaggtaagtcaacctgacgagaaggaagggagtgaggcggtggaggatttctacaagacaagccagaaacaagcggaggaacggcttgagaggtcagtggttaaagtccaggccatgttccggtccaagaaggctcagcaagattacagaaggatgaaactggctcatgaagaagctcagctggagtatgatgggatgcaagaacttgatcaaatggctacggaggagagctgaatggaataatagaggaggagtgggtgtgttgtgttgtggaggaactgtaaatttgtgcaaatgacgaggggcaatttcgaccttttaagaagcggttttcagaaaagtttcaaagggtgttgtggtaaattgatcctggagctgggaaatttccatagagcgtcttgtcgttagtttttctttttgtttggtggatagtcttgtattgcgttatgtgacttgtgagatttgacgctaaaaagctaaaacgttttttagtttgtctaaaagttctcctgcttactgtctttctt

SEQ ID NO: 892 - protein, 923 aa, Arabidopsis thaliana
  G2910,PCGL domain coordinates 22-130,778-847
MAGVDSGKLIGSEIHGFHTLQDLDIQTMLDEAYSRWLRPNEIHALLCNHKFFTINVKPVNLPKSGTIVLFDRKMLRNFRKDGHNWKKKKDGKTIKEAHEHLKVGNEERIHVYYAHGEDTPTFVRRCYWLLDKSQEHIVLVHYRETHEVHAAPATPGNSYSSSITDHLSPKIVAEDTSSGVHNTCNTGFEVRSNSLGSRNHEIRLHEINTLDWDELLVPADISNQSHPTEEDMLYFTEQLQTAPRGSVKQGNHLAGYNGSVDIPSFPGLEDPVYQNNNSCGAGEFSSQHSHCGVDPNLQRRDFSATVTDQPGDALLNNGYGSQDSFGRWVNNFISDSPGSVDDPSLEAVYTPGQDSSTPPTVFHSHSDIPEQVFNITDVSPAWAYSTEKTKILVTGFFHDSFQHLGRSNLICICGELRVPAEFLQMGVYRCFLPPQSPGVVNLYLSVDGNKPISQLFSFEHRSVQFIEKAIPQDDQLYKWEEFEFQVRLAHLLFTSSNKISVLTSKISPENLLEAKKLASRTSHLLNSWAYLMKSIQANEVPFDQARDHLFELTLKNRLKEWLLEKVIENRNTKEYDSKGLGVIHLCAVLGYTWSILLFSWANISLDFRDKQGWTALHWAAYYGREKMVAALLSAGARPNLVTDPTKEFLGGCTAADLAQQKGYDGLAAFLAEKCLVAQFKDMQTAGNISGNLETIKAEKSSNPGNANEEEQSLKDTLAAYRTAAEAAARIQGAFREHELKVRSSAVRFASKEEEAKNIIAAMKIQHAFRNFEVRRKIAAAARIQYRFQTWKMRREFLNMRKKAIRIQAAFRGFQVRRQYQKITWSVGVLEKAILRWRLKRKGFRGLQVSQPDEKEGSEAVEDFYKTSQKQAEERLERSVVKVQAMFRSKKAQQDYRRMKLAHEEAQLEYDGMQELDQMATEES

SEQ ID NO: 893 - DNA, 2223 bp, Arabidopsis thaliana
  G2918,family:JUMONJI
gaagttcaatttatttcgtcttccggaaatcaatccttttggtggctgtaaggtttaatgggcattgaaggtgtatcaacgtatttgaaatctggaaatatggacacaatttctgctccgccaggttttgtatctcaaacatcgtttgtgctgaggaatgtaccccgagacaaagaaagtcccaggtccgtgtcgagacaagagcagacaactggattcggcacagatgataaagatagttgcaatatgtttcttaaaagccgaccgtggatagtgcatggtcacacaattcccagctcagaggccttaaggccgaaaaaaactgaggtacggagaagacggcccctcaaagtgtctgagaccaaagtccttgaggaagctcctgtgttcaacccaaccgaagaggaattcagggacacactctcatatatatcaagcttgcgtgacagagctgagccgtatggaatctgttgtgttgttcctccaccttcatggaaacctccatgtcttctcaaggagaaacaaatatgggaggcttctacatttttccctcaagttcagctctttggaattcagaccgagaaccgaaagattaaaaaggaggttgatgcagatagtaatgatgctgcatctgaaggggttcagttatgtagagtagaacgtggtcctgggtatactttgaagtcctttaaaaactttgcagatacatacaagaagagtcattttggcatgaaggatgaggttttgggttcagagaactcatctccatcacttaaaccaaatgagctaattgtggcagacattgaaaaagagtacagacaaattgttgagagtccacttattgaaattggggtgctttatggcaatgatttagacactgcaacgtttggaagtggatttcccttatctgcaccatctgaatctagcaaatattcatcaggttggaatctgaacagtacggctaagcttcctggttctcttctatcattagaagactgcgaatcagtttgtgttcctcgtctaagtgtaggaatgtgcttgtcttcccagttctggaaatctgagaaggagagactctactctctctgctatttgcatgtgggcgctcctagagtgtggtattccgtagcaggatgtcatcgatcaaagtttaaggctgccatgaaaagcttcatccttgagatgtcaggagaacagccaaagaagagtcataatcctgtgatgatgatgtctccatatcaattgagcgtggagggtataccagtgacccgctgtgtccagcaccctggccagtatgttattatatttccagggtcgtattactctgcctttgactgtggcttcaactgtttggagaaagcaaactttgctccccttgattggttgccccatggggatattgctgttcaggtgaatcaagagatgagtaaaacgtcgctgatatcgtatgataagctattatttagtgctgcaagggaagctgtaaaatgtcttaaggaatatgggttgtcgaagaaaaacacagcatgttacacgagatggaatgattcttgtgggacggatgggttgttctccaacataatcaagtcacggatcaaactggagaaaaatagacgtgaatttcttatcagttcactagaatcgcaaaggatggacaagagttatgatgctgtgaacaaaagggaatgctgtgtatgtcttggggatttgtatctttccgcggttaactgttcatgctctgctaatcgttactcgtgtctgaaccacatgaggaagctctgtgcatgtccgtgtgacagaaagagttttctctataggtacactatggatgagttgaatcttctcgttgaagccctggaaggtaaaaagctcagctctatgttcagatgggcaggcatagatcaaaaattctgtgcttctccagccaccacaagttcaaaacccgaagaagacaaaggcaaggaaacagatgaggttacaccctgtaatatcacgaggaaagatgtcgcagctggaactaaggaccagacaagagtgaaggcgagatctttggctgatatactgaatgttaaagatggaaacaatgatgcaaaggagactttagaatcttgttctaagaaatcaaacaggccatgcgataacgattcctctgaggccaacgcgccaaagaaacagaagcagtgatgaataatgaaggagattgtagtttagtcacaaaatgca

SEQ ID NO: 894 - protein, 708 aa, Arabidopsis thaliana
  G2918,JUMONJI domain coordinates 108-143,294-446
MGIEGVSTYLKSGNMDTISAPPGFVSQTSFVLRNVPRDKESPRSVSRQEQTTGFGTDDKDSCNMFLKSRPWIVHGHTIPSSEALRPKKTEVRRRRPLKVSETKVLEEAPVFNPTEEEFRDTLSYISSLRDRAEPYGICCVVPPPSWKPPCLLKEKQIWEASTFFPQVQLFGIQTENRKIKKEVDADSNDAASEGVQLCRVERGPGYTLKSFKNFADTYKKSHFGMKDEVLGSENSSPSLKPNELIVADIEKEYRQIVESPLIEIGVLYGNDLDTATFGSGFPLSAPSESSKYSSGWNLNSTAKLPGSLLSLEDCESVCVPRLSVGMCLSSQFWKSEKERLYSLCYLHVGAPRVWYSVAGCHRSKFKAAMKSFILEMSGEQPKKSHNPVMMMSPYQLSVEGIPVTRCVQHPGQYVIIFPGSYYSAFDCGFNCLEKANFAPLDWLPHGDIAVQVNQEMSKTSLISYDKLLFSAAREAVKCLKEYGLSKKNTACYTRWNDSCGTDGLFSNIIKSRIKLEKNRREFLISSLESQRMDKSYDAVNKRECCVCLGDLYLSAVNCSCSANRYSCLNHMRKLCACPCDRKSFLYRYTMDELNLLVEALEGKKLSSMFRWAGIDQKFCASPATTSSKPEEDKGKETDEVTPCNITRKDVAAGTKDQTRVKARSLADILNVKDGNNDAKETLESCSKKSNRPCDNDSSEANAPKKQKQ

SEQ ID NO: 895 - DNA, 2597 bp, Arabidopsis thaliana
  G2921,family:JUMONJI
tgatttttcaattcatatggaaaatcctccattagaatctgagatcaaagaggatatgtctttgaagaatcatcctccagacaaggataaggacaaagacactatcatggaacaacctagtagtccacgtcatcggaaggttgttgctagatggttacctgatgaagcacagaggccaattatcaatgacgctcccgtattcactccatcactagaggagtttgtagatccacttgcgtatatcgagaagatacgtccactagcagagccgtatggtatctgtcgaatcatcccaccatcgacatggaagcctccttgccggcttaaggagaagagtatatgggagcagacaaagtttcctactcggattcaaaccgtagacctgcttcagaaccgtgagccgatgaagaagaaaccgaagagtagaaagcggaaacggagaagaaactcgagaatgggttcgtctaagagacgatctggttcttctcccgctgaatcgacttcatcacccgaggctgaggagaagtttggtttcaattctggttcagacttcactcttgatgagtttgagaaatatgctctgcattttaaagactcgtactttgaaaagaaagactctggtggagatatagtaaaatggacaccgtctgtggatgatatagaaggggaatactggcggatagttgagcaaccaacagatgaagtggaggtttactatggagctgacttggagaatggggtgcttggaagcgggttttataaaagagccgagaagtttaccggtagcgatatggagcagtacacattatctggctggaacttgaataacttaccacggcttcctggctctgtactctcttttgaagattgtgacatatccggagttctagttccatggctatatgtgggaatgtgtttttcatcattttgttggcatgtggaggaccatcatttatattcacttaactatcatcactttggggagccaaaagtatggtatggtgttccaggaagcaatgcaaccgctctcgagaaggcgatgaggaaacatttacctgacttgttcgaagaacagcctgatctactacatggcctggttactcagttttctccttcaatactgaaagatgagggagtccaggcttaccgggtcgtgcagaattcaggggagtatgtattgacattcccgagggcgtatcatgctggattcaactgcggtttcaactgcgcagaagcggttaatgtggctccggttgattggttggctcatggacagaacgctgtggaactatatagtaaagagacaaggaagacttctctgtctcacgacaagcttcttcttggagcagcttatgaagcggtgaaggctctttgggaactctcagcttctgagggaaaggaaaatacaacaaatttgagatggaagagtttctgtgggaagaacgggacacttaccaacgcgatacaagctcggttacaaatggaagaggggagaattacagctcttggtagggattcttcaagcttgaagaagatggagaaggactttgattcaaactgtgaaagggaatgtttctcatgcttttatgatttgcatctctcggcttctggctgcaagtgctctcccgaagaatacgcgtgccttaaacatgcagatgatctttgttcatgtgatgtgaaagatggatttattcttctccggtacacaatggatgagttaagctcgttggtcagagcattggaaggggaatcagatgatttaaagatatgggcttccaaggttttaggcattgaacatagtgatgaagatcagacaaagactagttcagttatcagtgaggagaagaagttaaaggaaggttcttttgatctgaacattgacttagagatggattatcaagaagacgttaaagaagaagccagcactagtggcggcgagttaaccgcctcagagaaccttggtgtatcggtcgagcctataaacctcgggttcttgatttttggaaagctttggtgcaataagtatgctatattcccaaaaggattcaggagtcgtgtcaagttctacaatgttcttgatccaacaagaatgagcaattacatctctgaggttttggatgcaggactcatgggtccattgttcagggttactctggaagaatctccagacgagagcttcttcaatgtctctgcacaacaatgctgggaaatggtgatgcggagagttaaagatacatcaacaagtcttggtcttcctattttaccacagtttgagagtatcaacgggcttcaaatgtttggtttcctctcaccctctatagttcaggccattgaagctcttgacccaaaccatcgactagttgagtactggaaccacaagaaccaaacttcatcagactcaaaagatcacttcatatcatcaaactgttccgcaagtttaaccaaaggaaaacttttcggagtagatttgatgtaaacaaaaaagactgtaccaactccgagaccaacaacaacaacagaaacaacaatgacatatcttttagatagatagagagaagaaatttctttctgattttttttttttgttttgggggcat

SEQ ID NO: 896 - protein, 819 aa, Arabidopsis thaliana [sequence omitted]

SEQ ID NO: 897 - DNA, 2078 bp, Arabidopsis thaliana
  G2927,family:HLH/MYC
gaaaacaaaaatatggaacgaataattttccctccctccatctctccctctctctctggcttaatacagcaatgaagctttaatcatctcctcttattcttcatcttcaattctcaaaatcttctgttgtgtttggaaaaaagccacacgcgtgatcttcttacatggatgcattcttcttaacggatgatcccaatacccggaaccagttaatccggtcgctagctcaatcttttggatgtgtttacgtttgtctttggtcttactattttcctcgaccttctaactatttaatatcaatggatggatattacaatgaagcttctgaagaaccttcttcgtcttcttcttctggaagtttagctaggagcttgttccatgagtatcgccaatccgttatcccgctccaaaatgggcatgtgccaagcatggcgttcatgaacaatcttccatacgtagaaattcgaccacaagagagtcaaagacttgcttttaacgacacacaacgtctcttctatcaggaagccaggattcagacggtgatattcatgggttgccggagcggcgagatcgaactcggaatgacgtatgatactacaaatatgaaaattgaagcaagtcttcgagaatggttccctgaagatttcaatagaaagtcttctccggcaaactccgattatctccggccacctcattatccctcttcatcgtcttcttctcttagtcccaacaacatctccgaatattcctctcttttgttcccactcatccctaaaccttcaacgacgactgaggccgttaacgttccggtacttccaccgctagctccgatcaatatgatccatccacagcatcaagagcctttattccgtaaccgtcaacgtgaggaagaagcaatgacgcaagcaatcttagcggttttaacggggccatcaagtcctccgtcaacttcttcctcgccgcagcgtaaaggaagagccaccgcttttaagagatattactccatgattagtgaccgcggtagagccccgcttccgagtgttcggaagcaaagtatgatgacaagagcgatgtccttctacaataggcttaacattaaccagagagagcgttttactagggaaaacgctactacacacggcgagggaagcggtggaagtggagggggtggacgttatactagcgggccaagcgcaacgcaactgcaacatatgatatcggagaggaaacggcgagagaagcttaatgagagctttcaagcattgagatctctccttcctcccggaactaagaaagataaagcatcggtcctctccattgcaagagagcaactatcttctttgcaaggtgagatttcgaaactactagagagaaatcgggaggtagaggcaaagctagcaggagaaagagagattgaaaatgatttacgacccgaagagaggtttaacgttcgtataagacatatacctgaatcaacatctagagagaggactttggatctacgagttgttctaaggggagacatcattagggttgatgatttgatgataagacttctcgaattcttgaagcaaatcaacaatgtgagcttagtgtcaatcgaagctcgaactctagctagagcagagggggatacttcaattgttcttgtgatcagcttaaggctcaagattgagggtgaatgggacgaatcagccttccaagaagcagtcagaagggttgttgctgacttggctcactgacaacaagtttgactatttcgtaactatatactatatagtaattattaaatttctattcctcttttacgcttacaaattcatttttaatgatcgaaagattaaattatttatggacagtctattttttactatgacgtgtggcggctcctatcgttgtcgatggttcttattactgtggaatttttcagccgttcgtcatatttcttgaatcaatattgaccgtttgtttttattcagtttttagctattaccgtaaatttgtaataagcaatatctgtcatttataaaaacttgtctttgggacatcatcactctattacaaaatgttactttttt

SEQ ID NO: 898 - protein, 525 aa, Arabidopsis thaliana
  G2927,HLH/MYC domain coordinates 341-398
MDAFFLTDDPNTRNQLIRSLAQSFGCVYVCLWSYYFPRPSNYLISMDGYYNEASEEPSSSSSSGSLARSLFHEYRQSVIPLQNGHVPSMAFMNNLPYVEIRPQESQRLAFNDTQRLFYQEARIQTVIFMGCRSGEIELGMTYDTTNMKIEASLREWFPEDFNRKSSPANSDYLRPPHYPSSSSSSLSPNNISEYSSLLFPLIPKPSTTTEAVNVPVLPPLAPINMIHPQHQEPLFRNRQREEEAMTQAILAVLTGPSSPPSTSSSPQRKGRATAFKRYYSMISDRGRAPLPSVRKQSMMTRAMSFYNRLNINQRERFTRENATTHGEGSGGSGGGGRYTSGPSATQLQHMISERKRREKLNESFQALRSLLPPGTKKDKASVLSIAREQLSSLQGEISKLLERNREVEAKLAGEREIENDLRPEERFNVRIRHIPESTSRERTLDLRVVLRGDIIRVDDLMIRLLEFLKQINNVSLVSIEARTLARAEGDTSIVLVISLRLKIEGEWDESAFQEAVRRVVADLAH

SEQ ID NO: 899 - DNA, 1028 bp, Arabidopsis thaliana
  G2929,family:HLH/MYC
ctacaagaaaaatcaaaccaaattaaaagtactcatagatatcaaattccaatggattgtgttccttcattgtttatgcctgattcaacctacgaagatggattactattttctgattcttttcttctttctccgtttatatcataccaaaacaatgatgttttccattcgatcacaaacaaaattggtggaagcaataagaaacgaagtttgtgtgatataacatatggtgcgaatgaagccaacaaaaatgatgatgatcgagagagcaagaagatgaaacatagagacattgaaaggcaaagaagacaagaagtttcatctcttttcaaaagactaagaactctcttgccatttcaatatatccagggtaaacgctcgacatcagatcacatcgtgcaggcagtgaactacatcaaagacttacaaatcaaaatcaaagaactcaacgaaaagagaaatcgggtaaaaaaagtcatatcggccacaactactactcattcagctatagaggaatgcaccagtagtttatcatcatcagcagcatcaacactatcatcaagctgctcatgtgtaggagacaaacacattactgttgtggtcacaccttgtttagttggtgttgagatcatcataagttgttgtctcggacgaaacaagtcttgtctctcgagtgttcttcaaatgttagctcaagaacaaaggttcagtgtagttagttgcctctcagctagacggcaacagagattcatgcacaccattgtttcgcaggtggaggatggcaaacagatcaatattttggagcttaaggataaaataatgactatgtagccccatgtacaagaagaaaattagttactatgacaaatgaaaatattacgtggtttgaaattggaattttactgaatttcaatgtatgcattatttgagttgttagatactaagatcatgctattttagtgtatcggcttacttctgagtgcttagattaatgttacaaactaatgcttgtttttcatttttttttt

SEQ ID NO: 900 - protein, 259 aa, Arabidopsis thaliana
  G2929,HLH/MYC domain coordinates 70-130
MDCVPSLFMPDSTYEDGLLFSDSFLLSPFISYQNNDVFHSITNKIGGSNKKRSLCDITYGANEANKNDDDRESKKMKHRDIERQRRQEVSSLFKRLRTLLPFQYIQGKRSTSDHIVQAVNYIKDLQIKIKELNEKRNRVKKVISATTTTHSAIEECTSSLSSSAASTLSSSCSCVGDKHITVVVTPCLVGVEIIISCCLGRNKSCLSSVLQMLAQEQRFSVVSCLSARRQQRFMHTIVSQVEDGKQINILELKDKIMTM

SEQ ID NO: 901 - DNA, 778 bp, Arabidopsis thaliana
  G2930,family:HLH/MYC
agcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgat

SEQ ID NO: 902 - protein, 234 aa, Arabidopsis thaliana
  G2930,HLH/MYC domain coordinates 57-120
MSSQPNHQTSISSLLHDRLHIPPAETIVEKESAEKDTCQSQRKRKEPVLHEVDGSSSGAAKKQDHNAKERLRRMRLHASYLTLGTLLPDHSSSSSKKKWSAPSIIDNVITYIPKLQNEVGELTLRKQKLVELERRGPSIRAISVLELGESGYEAVVQICLKKENEDEFSNLLHVMEVQGLSVLSASTSQVCREQRVVCYNFHVKMDEKPCEGDDYITVLKNNIISSLRDNTKCK

SEQ ID NO: 903 - DNA, 1048 bp, Arabidopsis thaliana
  G2931,family:HLH/MYC
aagaaaataaaaagggcatgaattttccagattcttcattgttcacaccaaattttgcttatgaaaatgatttagatttctctagtttgatcactccttcaacgcgtgtatcattccaagaacctaaaccatgtaatccagtcattcatagtgcagggattgagaacgatggaagacaaaactgtgagacgaccatgacattaagcgaaatcatgaaaggagacgatgagccgaagaacaagagagctaaacataaagagcttgagagacaaagaaggcaagaaaacacatctctattcaagattctaagatatttattgccatctcaatacataaagggtaaacgttcttcggcagatcacgttctagaagcagtgaattacatcaaagacttacagaagaagatcaaagaggtcagcgaaaaaagagatagaatcaagagatctattactcatccatcatcaagaggagaattttcaataagatcattagcatcatcaacttgttcttgtgttggagacacgaacattgctgttgtggttaggccttgtttgatcggactagagatcgtagtaagttgttgtaacagacacgaatcttgtctatcaagtgttcttcaactcctggctcaagagcaatgctttaatattgttagttgcatctcaactagactacaccaaggattcatacacaccattgcttctgaggtcgaggagggaatagaggtttatttctcagagcttcaagaaaagataatcaaaattggaacctcaagagtcactactcgctagtcagagtttattaaacctaaaaattttatgaatttacgtcctaattaagatatatatcctcaaccattcccaccaccacaagcatgttgtgtttttagtttttagaagtttatattgttcaggatgtggatgctgtttgaattgttgactaatacaaaaaaaattatgaattgtttttttcctataacaagttgtatgaataatttgattaatgcaaaattttgtggcaaaaaaaaaaaaaaaaaaaaaaaaaaaaa

SEQ ID NO: 904 - protein, 257 aa, Arabidopsis thaliana
  G2931,HLH/MYC domain coordinates 71-131
MNFPDSSLFTPNFAYENDLDFSSLITPSTRVSFQEPKPCNPVIHSAGIENDGRQNCETTMTLSEIMKGDDEPKNKRAKHKELERQRRQENTSLFKILRYLLPSQYIKGKRSSADHVLEAVNYIKDLQKKIKEVSEKRDRIKRSITHPSSRGEFSIRSLASSTCSCVGDTNIAVVVRPCLIGLEIVVSCCNRHESCLSSVLQLLAQEQCFNIVSCISTRLHQGFIHTIASEVEEGIEVYFSELQEKIIKIGTSRVTTR

SEQ ID NO: 905 - DNA, 1038 bp, Arabidopsis thaliana
  G2936,family:HLH/MYC
atagattccatctcaaattcggtcttatcatcttttttcctacttcatcccatcaaagtctctctagctatatattcttctcacacataacataagtggacaaaaaaaatgtgtaccttaacgccaatgtttccaagtaagcagcaagaatggtactctgcttcaacaatggagtatccatggctgcagtctcaagttcattccttttcacctactctccattttccttccttccttcatcctttagatgattccaagagccataacatcaatcttcatcatatgagtcttagtcacagcaataatactaacagtaacaataacaattatcaagaagaagatcgaggagcggtggttttggagaagaaactgaatcacaacgcaagcgaacgagaccgccgtagaaaacttaacgccttgtactcttcacttcgtgctctcttgcctctttctgatcaaaagaggaagctgagcattcctatgacggtagcgagagtagtgaaatacataccagagcagaagcaagaacttcaacgtttgtctcggagaaaagaagagctcttgaagaggatctcgagaaaaactcaccaagagcagctgagaaacaaagcaatgatggactcaatagattcttcttcctctcaacggatcgcagcaaattggctcactgacacagagattgctgtccagattgctacgtcgaaatggacatctgtttcagacatgttgcttaggttagaagaaaacgggcttaatgtcataagcgtctcttcttccgtttcttccaccgcaaggatcttctacactctacatcttcagatgagaggagattgcaaagtgagactggaggaactcatcaatggtatgctcttgggattacgccaatcataatgagcgatatgaagtgtttaaaagagtgaatgttgttagtttatgttagacttttatcaaatctgtaacatttttttcttcttctgattaatgattattcaactggaaaacttattcaataaagagaaattgcaattaaaaaaaaaa

SEQ ID NO: 906 - protein, 260 aa, Arabidopsis thaliana
  G2936,HLH/MYC domain coordinates 82-142
MCTLTPMFPSKQQEWYSASTMEYPWLQSQVHSFSPTLHFPSFLHPLDDSKSHNINLHHMSLSHSNNTNSNNNNYQEEDRGAVVLEKKLNHNASERDRRRKLNALYSSLRALLPLSDQKRKLSIPMTVARVVKYIPEQKQELQRLSRRKEELLKRISRKTHQEQLRNKAMMDSIDSSSSQRIAANWLTDTEIAVQIATSKWTSVSDMLLRLEENGLNVISVSSSVSSTARIFYTLHLQMRGDCKVRLEELINGMLLGLRQS

SEQ ID NO: 907 - DNA, 3071 bp, Arabidopsis thaliana
  G294,family:MISC
agaatgggaagtaaccgtcctaagaatttccggcggcgaggggacgacggcggcgatgaaattgacggtaaagttgctaccccctcgtcaaaaccgacttcgactctttcctcctcgaaacctaaaacactctcagcctcggccccgaagaagaaactcctaagtttcgccgacgacgaggaggaggaagaagatggagctccccgtgtgacgataaagcctaagaacggcagagaccgtgtcaaatcctcttcccgtctcggcgtttcgggatcttctcacagacactcttcaaccaaggaacgtcgtcccgcttcttctaacgtgcttcctcaggccggctcttattcgaaagaggcgctgctcgagctccagaagaacacacggacgcttccttattctcgctctagtgccaatgccgagccgaaggtagtgcttaagggtttaatcaaacctccgcaggatcatgagcagcagagtctgaaggatgtagttaaacaggtttcggatttggacttcgatgaggaaggggaagaagagcagcatgaagatgcgtttgctgatcaggcagcgattattagagccaagaaagagaggatgaggcagtcacgttcagctccggcgcctgattacatatcactagatggtggtatcgtaaatcattctgctgttgaaggagtcagcgacgaggatgcggattttcagggaattttcgtcggtccgagacctcagaaagatgataagaaaggtgtgtttgatttcggtgatgaaaatcctactgctaaagaaaccacgacaagtagtatttatgaggatgaggatgaagaagataagttgtgggaggaggagcaatttaagaagggtattggtaaaagaatggacgaagggtcgcataggactgtaactagtaatgggattggcgtgcctttgcattctaaacagcagacactgccacaacagcaaccgcagatgtatgcttatcatgccgggacaccaatgccgaatgtttctgtcgctcctaccattggcccagctactagtgttgatacattaccaatgtcacaacaagccgagcttgccaagaaggcattgaaagacaatgttaagaagcttaaggaatctcatgcaaaaacgttatcctcccttaccaagacagatgagaatctgactgcgtcgttgatgagtatcacagctcttgaaagttcgctatctgcagctggagataagtatgtgttcatgcaaaaactcagagacttcatttctgttatctgtgacttcatgcagaataagggttcattaattgaagaaattgaagatcaaatgaaggaacttaacgaaaaacatgctttatctattctagaaaggagaattgcagataacaatgatgaaatgatagagttgggggccgcagtgaaagcagcaatgacagttctaaacaaacatggaagcagtagttcagtgattgctgctgccacaggtgctgcgttggctgcctctacttctataaggcagcagatgaatcggacgcgtgggcttgatgaatttggcagagacgaaaatctgcagaagcgcagggaagtggaacagagggctgcagcccggcagaaaaggcgagctcgatttgaaaataagcgtgcatcagctatggaggttgatggaccttctctgaaaatagaaggagaatcaagcactgatgagagtgacactgagacttcagcttataaggagacaagagatagcttacttcagtgtgctgataaggtctttagtgatgcatctgaggagtactcccagctttcaaaggtgaaggcgagatttgagaggtggaagcgagactattcatcaacttatcgtgatgcttacatgtctttgaccgttccttccatcttttcaccttatgtaagactggagcttttgaaatgggatcctcttcatcaagatgtggatttctttgacatgaaatggcatgggttgctttttgattacgggaagccagaagatggggatgattttgcaccagatgatactgatgccaaccttgtccctgagctagtagaaaaggttgcaattccaattttgcaccatcagatagttcgttgctgggatatacttagcacccgggagacaagaaatgctgttgctgctacaagcttggtgacaaattatgtttctgcttcgagtgaggccttagcagaactatttgctgctattcgtgctcgccttgttgaagccattgcagctattagtgttccgacatgggatcctctggtattgaaggctgtacctaatactccacaagttgccgcatataggtttgggacatcagtccgtcttatgagaaatatatgtatgtggaaagacatcctggcgcttccagtgttggagaacttggctcttagtgaccttttgtttggaaaagttctaccccatgtcagaagcattgcatcaaatatccatgatgctgtgacaagaactgaaagaatcgttgcttctttgtctggagtgtggacaggaccaagcgtcacacgaacccacagtcgtccgctgcaacctcttgtggattgtactctgacacttagaagaattctcgagaaaaggcttggctcaggactggacgatgcggaaaccactggtctcgcccgcagattaaagagaatactagtcgagctccatgaacatgaccacgccagggaaattgtcagaacattcaatcttaaggaggcagtttgaccaaaagtttattgatgggaaactggaaagtcaacacagaaatctttagcctcaggttatcaggctcacctttcgggctgtaccagcaaaggctcatcgatttcaacatcgaggattacaagattttccctaggattattaggctagcaccaaaaccttccggaatccattttcagacacagaagagttttagtactttggcttaatgtaagtgtaacctcttgtggttgtagaaaaccttataataaatataagctaaagtatctcgagtcttttatttttccctttatatctgtatgagtttagatttagcaaagacaatattatttctatgaataaaa

SEQ ID NO: 908 - protein, 908 aa, Arabidopsis thaliana
  G294,MISC domain coordinates NA
MGSNRPKNFRRRGDDGGDEIDGKVATPSSKPTSTLSSSKPKTLSASAPKKKLLSFADDEEEEEDGAPRVTIKPKNGRDRVKSSSRLGVSGSSHRHSSTKERRPASSNVLPQAGSYSKEALLELQKNTRTLPYSRSSANAEPKVVLKGLIKPPQDHEQQSLKDVVKQVSDLDFDEEGEEEQHEDAFADQAAIIRAKKERMRQSRSAPAPDYISLDGGIVNHSAVEGVSDEDADFQGIFVGPRPQKDDKKGVFDFGDENPTAKETTTSSIYEDEDEEDKLWEEEQFKKGIGKRMDEGSHRTVTSNGIGVPLHSKQQTLPQQQPQMYAYHAGTPMPNVSVAPTIGPATSVDTLPMSQQAELAKKALKDNVKKLKESHAKTLSSLTKTDENLTASLMSITALESSLSAAGDKYVFMQKLRDFISVICDFMQNKGSLIEEIEDQMKELNEKHALSILERRIADNNDEMIELGAAVKAAMTVLNKHGSSSSVIAAATGAALAASTSIRQQMNRTRGLDEFGRDENLQKRREVEQRAAARQKRRARFENKRASAMEVDGPSLKIEGESSTDESDTETSAYKETRDSLLQCADKVFSDASEEYSQLSKVKARFERWKRDYSSTYRDAYMSLTVPSIFSPYVRLELLKWDPLHQDVDFFDMKWHGLLFDYGKPEDGDDFAPDDTDANLVPELVEKVAIPILHHQIVRCWDILSTRETRNAVAATSLVTNYVSASSEALAELFAAIRARLVEAIAAISVPTWDPLVLKAVPNTPQVAAYRFGTSVRLMRNICMWKDILALPVLENLALSDLLFGKVLPHVRSIASNIHDAVTRTERIVASLSGVWTGPSVTRTHSRPLQPLVDCTLTLRRILEKRLGSGLDDAETTGLARRLKRILVELHEHDHAREIVRTFNLKEAV

SEQ ID NO: 909 - DNA, 1333 bp, Arabidopsis thaliana
  G295,family:bZIP
ctgttttctaaggccactaatcactcggatttgtgtcaggtgaaatggatagttactggagacttaaaaacttggtgaatgatttgccagttagtacttctttaagccgacaaggatcaatatactcatggacagtagatcagtttcagaccagcttagggttagattgtggatcaatgaacatggatgagttggttaagcatatatcaagtgctgaagaaacacaagaggggtcgcagaggcaaggctcaactactctgcctccaacacttagcaaacaaaatgttggtgaagtttggaaatctatcacagaggaaaaacacaccaataacaatggaggagtaacaaacattactcatcttcagggacaacaaaccttaggggaaatcactcttgaagagtttttcatccgtgctggagcaagaggaggtaataccaatggtggctccattcatgactcatcgtcatcgatttccggtaatccacacactagtttgggtgttcagattcagccaaaagccatggtttctgattttatgaacaatatggttccaaggagtcatgattcttatttgcatcaaaatgtgaatggatctatgtcaacatatcaaccacaacaatctatcatgtctatgccaaatggttattcttatggaaaacaaatccgattctcaaatggttccttgggatctggtaaccaaagtctccaagatacgaagagaagcttggtcccaagtgttgcgacaattccaagtgaagccataacatgttcaccggttaccccatttccaacattaaatgggaaacaaaagattaacggtgagtcttcattactctcaccatctccatacattagtaatggtagtactagtacaagaggtgggaagattaatagtgaaattaccgcggaaaaacaattcgttgacaaaaagcttaggagaaagattaagaaccgagaatccgcagcgagatcacgggctcgaaagcaagctcaaactatggaggttgaagttgaacttgaaaacttaaagaaagattatgaagagctactaaaacaacatgtagagttgcggaaaagacaaatggaaccaggaatgattagccttcatgaacgaccggagagaaagctgaggagaacgaaatcggacatcaagtgaatcaatgaaacccgagttggaggatgatgatgagtttattttgttcatcatgttttgttttcgtatatttttgaccaaataagctatttattagacatcttattcttaaacccatttgataatgtcctaaagatcgaattctcatggtctaggggaaaatccaaaacttattttta

SEQ ID NO: 910 - protein, 370 aa, Arabidopsis thaliana
  G295,bZIP domain coordinates 287-354
MDSYWRLKNLVNDLPVSTSLSRQGSIYSWTVDQFQTSLGLDCGSMNMDELVKHISSAEETQEGSQRQGSTTLPPTLSKQNVGEVWKSITEEKHTNNNGGVTNITHLQGQQTLGEITLEEFFIRAGARGGNTNGGSIHDSSSSISGNPHTSLGVQIQPKAMVSDFMNNMVPRSHDSYLHQNVNGSMSTYQPQQSIMSMPNGYSYGKQIRFSNGSLGSGNQSLQDTKRSLVPSVATIPSEAITCSPVTPFPTLNGKQKINGESSLLSPSPYISNGSTSTRGGKINSEITAEKQFVDKKLRRKIKNRESAARSRARKQAQTMEVEVELENLKKDYEELLKQHVELRKRQMEPGMISLHERPERKLRRTKSDIK

SEQ ID NO: 911 - DNA, 315 bp, Arabidopsis thaliana
  G2965,family:Z-C2H2
atgacaggcaaagcaaagccaaagaagcacacagcgaaggagctccaagctaaagccgatgcagcgttgaccaatcgcggtggaggaaaggcagggctcgccgatagaaccggtaaggagaaaggtggtcacgcaaagtacgagtgtcctcactgcaagatcactgtaccggatctaaagacgatgcagatccatcatgaatcgaagcatccaaagctgacttatgaagagccgaggaatcttcatgaggctttagctgctcctgctgaatcatctaagcctaagcctggaatcagaggaagccttaagaagtga

SEQ ID NO: 912 - protein, 104 aa, Arabidopsis thaliana
  G2965,Z-C2H2 domain coordinates 49-70
MTGKAKPKKHTAKELQAKADAALTNRGGGKAGLADRTGKEKGGHAKYECPHCKITVPDLKTMQIHHESKHPKLTYEEPRNLHEALAAPAESSKPKPGIRGSLKK

SEQ ID NO: 913 - DNA, 1419 bp, Arabidopsis thaliana
  G2966,family:Z-C2H2
atggaagattcaagcaaaaaaagccaaaagaagaagaagaacaaaagcaagaacaacatcccaactgtttggttctcactcaagaaatccctccactgtaaatccgaaccatctgatgtccacgacccaatatccaccactaaacagcaacaacacctctccacaatctccaccaagaaaatctccggcatatcatccggcggagccgccgtatgcggtggtggtttatcaggatgttcaagatcaatagcaaatctcaaagacgtaatccatggaagcaaaagacatttcgagaaaccaccaataagtagtcctcgttctattggaagcaatgagtttctaaatcctataactcatgaagttattcttagtaactcaacttgtgagcttaagatcactggtgtcggagacatggcttcacctgtcggagcagcggattccggcggaggtggcggtggaggaaatggtcggtctacgacttatgtagggatgcttagaccaggaacaccgatgcattatcttaaccattcagcttcttacaggagccaaacaagaaagggttcgtttgctttgtcggagagagatcgaggaggaggaggaggaggagaagggttagggtttcatacaaacagaagggtttcattggagatgaacagagaatccaccattaatggaggcaacaattcctctgtttcttgtcataaatgtggtgaacagttcaataagcttgaagctgctgaagctcatcatctctctaaacatgccgtaacggagcttgtagaaggagattcatcaagaaaaatagtggagataatctgcagaacaagctggttaaagtcagagaaccaatgtggaagaatcgatagagttttaaaagtacacaacatgcagaagacattagctagattcgaggaatacagagaaacagttaaaatcagagcaagcaaacttcagaagaagcatccaagatgtctcgcagacggtaacgagctacttaggttccacggaaccaccgtggcttgtggtttaggtataaacgggtcaacaagtgtttgcacggcggagaaatgttgtgtctgtcggattatacgaaacgggttctcgtcgaaacgggagaagaataatggggttggtgttttcacggcgtctactagtggaagagcgttcgagtcgattttggttaacggtggagatgagagtggagatgttgatcggacggtgaggaaagtgttgattgtgtgtagggttatcgccggaagagttcatcggccggtggagaatgtggaggagatgaatgggttgatgagtgggtttgattctttggctggcaaagttggtttgtatacaaatgtggaggagctttatttgcttaatcctaaagctttgcttccttgctttgtggtcatttgcaagccctaa

SEQ ID NO: 914 - protein, 472 aa, Arabidopsis thaliana
  G2966,Z-C2H2 domain coordinates 233-254
MEDSSKKSQKKKKNKSKNNIPTVWFSLKKSLHCKSEPSDVHDPISTTKQQQHLSTISTKKISGISSGGAAVCGGGLSGCSRSIANLKDVIHGSKRHFEKPPISSPRSIGSNEFLNPITHEVILSNSTCELKITGVGDMASPVGAADSGGGGGGGNGRSTTYVGMLRPGTPMHYLNHSASYRSQTRKGSFALSERDRGGGGGGEGLGFHTNRRVSLEMNRESTINGGNNSSVSCHKCGEQFNKLEAAEAHHLSKHAVTELVEGDSSRKIVEIICRTSWLKSENQCGRIDRVLKVHNMQKTLARFEEYRETVKIRASKLQKKHPRCLADGNELLRFHGTTVACGLGINGSTSVCTAEKCCVCRIIRNGFSSKREKNNGVGVFTASTSGRAFESILVNGGDESGDVDRTVRKVLIVCRVIAGRVHRPVENVEEMNGLMSGFDSLAGKVGLYTNVEELYLLNPKALLPCFVVICKP

SEQ ID NO: 915 - DNA, 999 bp, Arabidopsis thaliana
  G2972,family:Z-C2H2
atgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataa

SEQ ID NO: 916 - protein, 332 aa, Arabidopsis thaliana
  G2972,Z-C2H2 domain coordinates 8-32,129-149,277-294
MSQRLHGCKTCGRKFGTLKGVYGHQRMHSGNHNRIEDENGLERIWGLKKKSRVCSVSAFDRFKGSSFMAEIEKHEVIEAALNLVMLCQGVYDFASISNLPLGDGFMDLELKPCPLRRKLQKKSRSSYKCSICEKSFVCSQALGSHQRLHRWKLVPKPEYIEDDSSLLDSSEAKKIVSKPSSFEHAQEEKILQCVEPKLEFHEQLAHSGFDKFDTCSKIRFSALPSPPEAKKIVSQPPSFEVSVDEKILYRAEPKLNFSEPLAHSCFDNSSSYRSIICGKSFVCSQALGGHQTLHRSIKGQLAGTEDGNSLSVTDSEASKIVAQPSSYKSQGI

SEQ ID NO: 917 - DNA, 1331 bp, Arabidopsis thaliana
  G2979,family:E2F
gaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagctttagtctttgtttgccttaaacaatagtaagaaacagagtattgttattgttaataaaagtcacacccaacaaattccgagtgactttgttctatacttgattcgaattcctatcctctccttaacttaatataaatgtttaatccatccaaaaaaaaa

SEQ ID NO: 918 - protein, 354 aa, Arabidopsis thaliana
  G2979,E2F domain coordinates 192-211
MSSAIVVSQDAESLGLQIYSRKEKSLGVLVSNFLRLYNRDDVDLIGLDDAAGQLGVERRRIYDVVNILESIGIVARRGKNQYSWKGFGEIPRSLDELKEEGMRERLGYSSSNNSDKVSNGCEREEPLTLTPDDQENSSSSKMDQKKEKSLWLLAQNFVKMFLCSDDDLITLDSAAKALLSDSPDSVHMRTKVRRLYDIANVFASMNLIEKTHIPVTRKPAYRWLGSKSIAERGLSLFNSGEPKRVFGTEITNLRAKRNKTYCSSIRKQIGYKKHDEENTEQESKPAASKYVFGPFSPIGASKTNNDKVGKGRLLEIEALASTYQPQYCNQEITGLLGHFTEAWKKWYAEVDRNK

SEQ ID NO: 919 - DNA, 1244 bp, Arabidopsis thaliana
  G2980,family:E2F
tgtctctctttctcccgcaggtcaccgagaaaatatcttttgttgtctccacccaccccacccaggttatggattctctcgctctcgctccccaggtttacagccgcaaggacaaatctctcggcgttcttgtcgccaatttcttgacactgtataatcgtcccgatgttgatctatttgggctcgatgatgccgccgcgaaattaggagttgaacgtcggcgtatttatgatgtggtcaatatattggagagtattgggcttgttgcaagaagtgggaagaatcagtattcgtggaaaggttttggagctgttcctcgtgctctatctgaactcaaagaagagggaatgaaagagaagtttgcgatcgtcccttttgtggccaagtcagagatggtcgtttatgagaaagaaggagaagaatctttcatgttatctcctgatgatcaagagttctcaccatctcccagacctgacaacaggaaggagagaactctctggctacttgcacagaactttgtgaagctgtttttatgctctgatgatgatctggtaacatttgatagcgctacaaaagcattgctgaatgagtctcaggatatgaatatgagaaagaaagttagacgcctttacgacattgcaaatgtgttttcctcaatgaagctaatcgagaagactcatgtcccagagactaagaagccggcatataggtggttgggatctaaaaccatatttgaaaacagattcattgatggttctgcaagcttatgtgatcgtaatgtgcctaaaaagcgggcatttgggaccgaactcacaaacgttaacgcaaagagaaacaaatcaggttgttctaaagaagacagcaagcgtaatggaaatcaaaacacaagcattgttatcaagcaagaacaatgtgatgatgtgaaaccggacgtgaagaattttgcctctggatcatccactcctgcaggcacttctgagagtaacgatatgggaaacaacattaggccaagaggtagacttggagttatcgaagccctttctactctttaccaaccatcatattgcaatcctgagttacttggtctttttgcgcattacaacgagacatttaggtcatatcaagaagagtttggtcgggagaaatgacttaatcatcaggtagattaacttgcggggcgtaacttcaattctctaatcacaagccaaatttcttttgctcatttgcgttaaactacagaaaaa

SEQ ID NO: 920 - protein, 359 aa, Arabidopsis thaliana
  G2980,E2F domain coordinates 39-337
MDSLALAPQVYSRKDKSLGVLVANFLTLYNRPDVDLFGLDDAAAKLGVERRRIYDVVNILESIGLVARSGKNQYSWKGFGAVPRALSELKEEGMKEKFAIVPFVAKSEMVVYEKEGEESFMLSPDDQEFSPSPRPDNRKERTLWLLAQNFVKLFLCSDDDLVTFDSATKALLNESQDMNMRKKVRRLYDIANVFSSMKLIEKTHVPETKKPAYRWLGSKTIFENRFIDGSASLCDRNVPKKRAFGTELTNVNAKRNKSGCSKEDSKRNGNQNTSIVIKQEQCDDVKPDVKNFASGSSTPAGTSESNDMGNNIRPRGRLGVIEALSTLYQPSYCNPELLGLFAHYNETFRSYQEEFGREK

SEQ ID NO: 921 - DNA, 1267 bp, Arabidopsis thaliana
  G2982,family:E2F
tgtttgtttatagcgggaactctcacccaaagtaatttcatctccgattttttttttttggttgttgttcgcatctctgtgtaataaaaagagtaaaaccaaaaccctagaaaaaaaatctccatctttttttattccgccattggaagatcgatcactgagaaggatgagtatggagatggagttgtttgtcactccagagaagcagaggcaacatccttcagtgagcgttgagaaaactccagtgagaaggaaattgattgttgatgatgattctgaaattgggtcagagaagaaagggcaatcaagaacttctggaggcgggcttcgtcaattcagtgttatggtttgtcagaagttggaagccaagaagataactacttacaaggaggttgcagacgaaattatttcagattttgccacaattaagcaaaacgcagagaagcctttgaatgaaaatgagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaagatggatcgtaataaagttatgagcagtgtgcaaaagaaggctgcttttcttaaagagttgagagaaaaggtctcaagtcttgagagtcttatgtcgagaaatcaagagatggttgtgaagactcaaggcccagcagaaggatttaccttaccattcattctacttgagacaaaccctcacgcagtagtcgaaatcgagatttctgaagatatgcaacttgtacacctcgacttcaatagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatactaaaaaattatacatctggtttagtgttcaattgagagagactgtaaaatcaattcataggccaacaaatgtttgtttatccaattttcctttttattcgaacttgatgcgatatttcaacggaaacagaaactattgttttaaaccaaaaaaaaaaaaaaaaaa

SEQ ID NO: 922 - protein, 292 aa, Arabidopsis thaliana
  G2982,E2F domain coordinates 107-124
MSMEMELFVTPEKQRQHPSVSVEKTPVRRKLIVDDDSEIGSEKKGQSRTSGGGLRQFSVMVCQKLEAKKITTYKEVADEIISDFATIKQNAEKPLNENEYNEKNIRRRVYDALNVFMALDIIARDKKEIRWKGLPITCKKDVEEVKMDRNKVMSSVQKKAAFLKELREKVSSLESLMSRNQEMVVKTQGPAEGFTLPFILLETNPHAVVEIEISEDMQLVHLDFNSTPFSVHDDAYILKLMQEQKQEQNRVSSSSSTHHQSQHSSAHSSSSSCIASGTSGPVCWNSGSIDTR

SEQ ID NO: 923 - DNA, 750 bp, Arabidopsis thaliana
  G2983,family:HB
atgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaaacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatgagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatga

SEQ ID NO: 924 - protein, 249 aa, Arabidopsis thaliana
  G2983,HB domain coordinates 88-148
MKVHEFSNGFSSSWDQHDSTSSLSLSCKRLRPLAPKLSGSPPSPPSSSSGVTSATFDLKNFIRPDQTGPTKFEHKRDPPHQTHPGGTRWNPTQEQIGILEMLYKGGMRTPNAQQIEHITLQLGKYGKIEGKNVFYWFQNHKARERQKQKRNNLISLSCQSSFTTTGVFNPSVTMKTRTSSSLDIMREPMVEKEELVEENEYKRTCRSWGFENLEIENRRNKNSSTMATTFNKIIDNVTLELFPLHPEGR

SEQ ID NO: 925 - DNA, 1467 bp, Arabidopsis thaliana
  G2985,family:OTHER
atggaattcggcgacggcgtttccttcgccgtcgtccccactgtcttcaaaagagaagactacaaacgaactaaacacgacaccgtcttctccaagtggcagtttgatgctgcacaggtacttataggatccaacgattgggaagatttcaaaaacggaaaagatggtgtaggtagatacagagtccagaacttacctcgtaaatcttgtccgggtctgtatgagctcggtgtagcggtcatcggtcaagaacaatgtcgaaagcttgaaccagatattgttcttgcttcatatctaggacaagctgaaagtgttaggtctagacttcagcgttatggaagatccggtgctcatttgcgcaatgttaacaaccttaacgactgtgaaactattgaatctccagttaaggctgttactggaggtttatttgaagacatattttcgaaaggaggctcgattttatacagatgggctccgatgggatctaagagagaagctgaggcaacagaagggatgctcttgagcacatttgactatgcttggaacaaaggaagtaacggggagcgaaggcagcttgatttgcttaagaagctcggtgatcgcgagtttatgagcaagagaaagtccggtatatctcgaatgctgtttccttttcttcggaaccaagttggtatcagaataaaaggagagaagcatgtgcttaaagaagagaggaagctaacctgtgatgttgatgaagagaagagtaataatttcctcacttcaatactcaaactcacccggtctagacctcaaccggtttcagacagatttgatgaggttgatggttcttgttctgatattgtttgtggagtcttacttgaagatggtggctgttgcattagaagtccagtcaaagggagaaagagatgcatagagcataaaggacagagagtttgccgtgtttcacccgaaaaacagacaccgccaaagtccgagattttcactggacaagatcatcacaatcataaagactctgatgttgtgtgtggagtgatcttacctgacatggaaccttgcaataagagacctgttcctggaagaaaacgatgtgaggatcataaaggcatgaggatcaatgcttttctttttcttcttaaccaaactgaccgtgagaaaaccgtcaaagacgagaaacctgatcccgaatcgcataccgagtcaatcgaagaagaagctttgactcgcttctgtgaagctacaacaaagaatgggttaccttgcacaagaagttctcctaaaggaagcaaaaggtgttggcaacataaggagaaaacttccagcgatacttcgccggtatattttcagccagaggcagcaaaaaacgtagcttgtggagttaaattaggcaatggattgatctgtgagagatctccggtaaaaggacgtaagagatgtgaagagcataagggaatgagaatcacctaa

SEQ ID NO: 926 - protein, 488 aa, Arabidopsis thaliana
  G2985,OTHER domain coordinates 353-488
MEFGDGVSFAVVPTVFKREDYKRTKHDTVFSKWQFDAAQVLIGSNDWEDFKNGKDGVGRYRVQNLPRKSCPGLYELGVAVIGQEQCRKLEPDIVLASYLGQAESVRSRLQRYGRSGAHLRNVNNLNDCETIESPVKAVTGGLFEDIFSKGGSILYRWAPMGSKREAEATEGMLLSTFDYAWNKGSNGERRQLDLLKKLGDREFMSKRKSGISRMLFPFLRNQVGIRIKGEKHVLKEERKLTCDVDEEKSNNFLTSILKLTRSRPQPVSDRFDEVDGSCSDIVCGVLLEDGGCCIRSPVKGRKRCIEHKGQRVCRVSPEKQTPPKSEIFTGQDHHNHKDSDVVCGVILPDMEPCNKRPVPGRKRCEDHKGMRINAFLFLLNQTDREKTVKDEKPDPESHTESIEEEALTRFCEATTKNGLPCTRSSPKGSKRCWQHKEKTSSDTSPVYFQPEAAKNVACGVKLGNGLICERSPVKGRKRCEEHKGMRIT

SEQ ID NO: 927 - DNA, 1011 bp, Arabidopsis thaliana
  G2989,family:ZF-HB
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacat

SEQ ID NO: 928 - protein, 312 aa, Arabidopsis thaliana
  G2989,ZF-HB domain coordinates 50-105,192-255
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 929 - DNA, 1107 bp, Arabidopsis thaliana
  G2990,family:ZF-HB
agtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcggata

SEQ ID NO: 930 - protein, 334 aa, Arabidopsis thaliana
  G2990,ZF-HB domain coordinates 54-109,200-263
MMDMTPTITTTTTPTPKSPEPESETPTRIQPAKPISFSNGIIKRHHHHHHPLLFTYKECLKNHAAALGGHALDGCGEFMPSPSSISSDPTSLKCAACGCHRNFHRRDPDNNNDSSQIPPPPSTAVEYQPHHRHHPPPPPPPPPPRSPNSASPPPISSSYMLLSLSGTNNNNNNLASFSDLNFSAGNNHHHHHQHTLHGSRKRFRTKFSQFQKEKMHEFAERVGWKMQKRDEDDVRDFCRQIGVDKSVLKVWMHNNKNTFNRRDIAGNEIRQIDNGGGNHTPILAGEINNHNNGHHGVGGGGELHQSVSSGGGGGGFDSDSGGANGGNVNGSSSS

SEQ ID NO: 931 - DNA, 729 bp, Arabidopsis thaliana
  G2992,family:ZF-HB
atggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttcatcttcttga

SEQ ID NO: 932 - protein, 242 aa, Arabidopsis thaliana
  G2992,ZF-HB domain coordinates 29-84,156-219
MDLSSKPQQQLLNSLPIAGELTVTGEMGVCYKECLKNHAANLGGHALDGCGEFMPSPTATSTDPSSLRCAACGCHRNFHRRDPSENLNFLTAPPISSPSGTESPPSRHVSSPVPCSYYTSAPPHHVILSLSSGFPGPSDQDPTVVRSENSSRGAMRKRTRTKFTPEQKIKMRAFAEKAGWKINGCDEKSVREFCNEVGIERGVLKVWMHNNKYSLLNGKIREIEHGLCLNTHSNDGDGSSSS

SEQ ID NO: 933 - DNA, 1144 bp, Arabidopsis thaliana
  G2993,family:ZF-HB
tctctttctctctctctctctctctctctttatcttctttcttcaaagtctatcactttataaaaccctaattaaatctctaaactccttagcctctctctattctcagaaccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgccattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaagaaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttata

SEQ ID NO: 934 - protein, 310 aa, Arabidopsis thaliana
  G2993,ZF-HB domain coordinates 85-138,222-285
MEIASQEDPIPINTSYGNSGGGHGNMNHHHHANSAPSSLNITTSNPLLVSSNSNGLGKNHDHSHHHHVGYNIMVTNIKKEKPVVIKYKECLKNHAATMGGNAIDGCGEFMPSGEEGSIEALTCSVCNCHRNFHRRETEGEEKTFFSPYLNHHQPPPQQRKLMFHHKMIKSPLPQQMIMPIGVTTAGSNSESEDLMEEEGGGSLTFRQPPPPPSPYSYGHNQKKRFRTKFTQEQKEKMISFAERVGWKIQRQEESVVQQLCQEIGIRRRVLKVWMHNNKQNLSKKSNNVSNNVDLSAGNNDITENLASTNP

SEQ ID NO: 935 - DNA, 782 bp, Arabidopsis thaliana
  G2995,family:ZF-HB
cagagtataaacgcactagtgagtgaaataagaatcagacatgagctcgttatcaaaaccaaacagacaatttttgtcaccaacaacaaacaaccaagacaccggcagagaacaaacaatcgcctgcgcccgagatatggttgtcttgtacaacgagtgccttaaaaaccacgcggtcagtctcggaggccacgctcttgacggctgcggtgagttcacaccaaagtcaaccaccatcctcacggaccctccgtcccttaggtgcgatgcttgtggctgccatcgcaacttccaccgtcgtagtccttctgacggcttcagtcagcaccggtcaccaccgtctccgttacagctgcagccactcgcccctgttccgaacttgcttctctctcttagctccggtttctttggaccctcggatcaagaagtcaagaacaaatttacggtggaaagggatgttaggaagactgcgatgattaagaaacataagaggacgaaattcacggcggagcagaaggtgaagatgagaggtttcgcggagagagcggggtggaagattaacggctgggatgagaagtgggtgagagagttttgtagtgaagttggaatagagagaaaagttcttaaggtttggatccacaacaataagtactttaacaacgggaggagcagagacacgacgtcctctatgtctttgaatttgaagttgtagatctctttacagtgatgggtcttcatcttcttgagataaggaaaaaccgaaacaaaaagaggttacggta

SEQ ID NO: 936 - protein, 191 aa, Arabidopsis thaliana
  G2995,ZF-HB domain coordinates 3-58,115-178
MVVLYNECLKNHAVSLGGHALDGCGEFTPKSTTILTDPPSLRCDACGCHRNFHRRSPSDGFSQHRSPPSPLQLQPLAPVPNLLLSLSSGFFGPSDQEVKNKFTVERDVRKTAMIKKHKRTKFTAEQKVKMRGFAERAGWKINGWDEKWVREFCSEVGIERKVLKVWIHNNKYFNNGRSRDTTSSMSLNLKL

SEQ ID NO: 937 - DNA, 886 bp, Arabidopsis thaliana
  G2996,family:ZF-HB
gtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcact

SEQ ID NO: 938 - protein, 279 aa, Arabidopsis thaliana
  G2996,ZF-HB domain coordinates 73-126,191-254
MEFEDNNNNNDEEQEEDMNLHEEEEDDDAVYDSPPLSRVLPKASTESHETTGTTSTGGGGGFMVVHGGGGSRFRFRECLKNQAVNIGGHAVDGCGEFMPAGIEGTIDALKCAACGCHRNFHRKELPYFHHAPPQHQPPPPPPGFYRLPAPVSYRPPPSQAPPLQLALPPPQRERSEDPMETSSAEAGGGIRKRHRTKFTAEQKERMLALAERIGWRIQRQDDEVIQRFCQETGVPRQVLKVWLHNNKHTLGKSPSPLHHHQAPPPPPPQSSFHHEQDQP

SEQ ID NO: 939 - DNA, 930 bp, Arabidopsis thaliana
  G2998,family:ZF-HB
atggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaa

SEQ ID NO: 940 - protein, 309 aa, Arabidopsis thaliana
  G2998,ZF-HB domain coordinates 74-127,240-303
MDMRSHEMIERRREDNGNNNGGVVISNIISTNIDDNCNGNNNNTRVSCNSQTLDHHQSKSPSSFSISAAAKPTVRYRECLKNHAASVGGSVHDGCGEFMPSGEEGTIEALRCAACDCHRNFHRKEMDGVGSSDLISHHRHHHYHHNQYGGGGGRRPPPPNMMLNPLMLPPPPNYQPIHHHKYGMSPPGGGGMVTPMSVAYGGGGGGAESSSEDLNLYGQSSGEGAGAAAGQMAFSMSSSKKRFRTKFTTDQKERMMDFAEKLGWRMNKQDEEELKRFCGEIGVKRQVFKVWMHNNKNNAKKPPTPTTTL

SEQ ID NO: 941 - DNA, 891 bp, Arabidopsis thaliana
  G2999,family:ZF-HB
tattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 942 - protein, 262 aa, Arabidopsis thaliana
  G2999,ZF-HB domain coordinates 80-133,198-261
MEVREKKDEKMEMTRRKSSALDHHRLPPYTYSQTANKEKPTTKRNGSDPDPDPDLDTNPISISHAPRSYARPQTTSPGKARYRECQKNHAASSGGHVVDGCGEFMSSGEEGTVESLLCAACDCHRSFHRKEIDGLFVVNFNSFGHSQRPLGSRHVSPIMMSFGGGGGCAAESSTEDLNKFHQSFSGYGVDQFHHYQPKKRFRTKFNEEQKEKMMEFAEKIGWRMTKLEDDEVNRFCREIKVKRQVFKVWMHNNKQAAKKKDL

SEQ ID NO: 943 - DNA, 759 bp, Arabidopsis thaliana
  G3,family:AP2
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 944 - protein, 153 aa, Arabidopsis thaliana
  G3,AP2 domain coordinates 28-95
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 945 - DNA, 553 bp, Arabidopsis thaliana
  G30,family:AP2
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 946 - protein, 133 aa, Arabidopsis thaliana
  G30,AP2 domain coordinates 16-80
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 947 - DNA, 465 bp, Arabidopsis thaliana
  G3006,family:HS
atgctcttgctcttcctctctatgctaaaatctcgaaaccctaattattctaagattctaatttgtgaagtttgtgaggttttagggatgggttacaatttctacatgagagtgtatgaggttgttgatgatgcttcaacggatgcaatcatatcgtggagcgaaagcaacaacagtttcattatctggaatgttggagagttttacagaaggattctgcctaaatatgtagacttgggcacaaacctctcacggtttttctccaaccttcgttctcatgggttcaaaatagttaaaggaagaactggagtattggaatttggacatgaagattttatcagagataaactggagcttatgaagaagatggttagcgataaacgtaaagcaaggaaagctgctaaatccaaagcaaggaaagctagagttcaagtcgagtttctcttccaacacttgcaaatttga

SEQ ID NO: 948 - protein, 154 aa, Arabidopsis thaliana
  G3006,HS domain coordinates 38-153
MLLLFLSMLKSRNPNYSKILICEVCEVLGMGYNFYMRVYEVVDDASTDAIISWSESNNSFIIWNVGEFYRRILPKYVDLGTNLSRFFSNLRSHGFKIVKGRTGVLEFGHEDFIRDKLELMKKMVSDKRKARKAAKSKARKARVQVEFLFQHLQI

SEQ ID NO: 949 - DNA, 1290 bp, Arabidopsis thaliana
  G3007,family:TUBBY
ataaacttagctcccagaaagttctaaacttgatacttgaaagcaatccatccagaaagggaaaaaaaacatggctggttcgagaaaagtgaatgatttgttggaggaaaataagggaaatgtggacacaattacagggtctttatccactcaaaagggagaggataaggagaatgtgtcgccggagaaagtctctacctctgtggaaactcggaaactagatcgagctttgaagtctcaatcgatgaagggtaactctgggtttccaacggaagttacaaatttcaaatctttctcaactggtggtcgaacagctctgaagcagtcatcactgcaagcgtgtatgcagaagaacagtgaggttgataagagtagtttcggaatgaaaacttggactagtgttgattcagagcattcaagttcgttgaaagtgtgggagttttcggattctgaagctgcccctgcttcctcttggtctactttgcccaacagggctttgttgtgcaagacactacctttggatgtgggaagatgcacttgtctgattgtgaaagaacaatcacctgaaggcttgagccacggatctgtatattcactttatacacatgaaggtcgggggcgtaaagaccggaagttagcagttgcttaccatagccgacgtaatgggaaatctatatttagggtggcacagaatgttaagggattgctgtgcagttcggatgaaagttatgtcggttccatgacggctaatctcttgggttccaagtactacatatgggacaagggagttcgagttggttctgtaggtaaaatggtgaagccgcttctttcggttgtaatattcacacccaccataacaacttggacagggagctacagaagaatgagaactttgctaccaaagcagcagccaatgcagaaaaacaacaataagcaggttcaacaagctagtaaactaccgcttgattggcttgagaataaggaaaaaattcagaagctatgctcaaggataccacattacaacaaaatctccaagcagcatgagttagacttcagagacagaggaagaacaggactgagaatacagagctcggtgaagaactttcagctaacactcacggagactccaaggcagacaattcttcaaatggggagagttgacaaagcaagatatgtaatcgacttcaggtatccattctcaggctaccaagcattctgcatttgcttggcttctattgattccaagctttgttgtactgtttgatcattaataaacggacgagttcaatc

SEQ ID NO: 950 - protein, 397 aa, Arabidopsis thaliana
  G3007,TUBBY domain coordinates 21-137,141-188
MAGSRKVNDLLEENKGNVDTITGSLSTQKGEDKENVSPEKVSTSVETRKLDRALKSQSMKGNSGFPTEVTNFKSFSTGGRTALKQSSLQACMQKNSEVDKSSFGMKTWTSVDSEHSSSLKVWEFSDSEAAPASSWSTLPNRALLCKTLPLDVGRCTCLIVKEQSPEGLSHGSVYSLYTHEGRGRKDRKLAVAYHSRRNGKSIFRVAQNVKGLLCSSDESYVGSMTANLLGSKYYIWDKGVRVGSVGKMVKPLLSVVIFTPTITTWTGSYRRMRTLLPKQQPMQKNNNKQVQQASKLPLDWLENKEKIQKLCSRIPHYNKISKQHELDFRDRGRTGLRIQSSVKNFQLTLTETPRQTILQMGRVDKARYVIDFRYPFSGYQAFCICLASIDSKLCCTV

SEQ ID NO: 951 - DNA, 1950 bp, Arabidopsis thaliana
  G3009,family:SCR
cctcacttccctcattggacctctctaactctcctctcttaccttctcctgtttaaattcttctcctttctttccacaatttctgtctaaccaattccaacaccaaaaaattccatttcttgacgatgaaacgaagccatcaagaaacgtctgtagaagaagaagctccttcaatggtggagaagttagaaaatggttgtggtggtggtggagacgataacatggacgagtttcttgctgttttgggttacaaggttcgatcttcagacatggcagatgttgcacagaagcttgaacagcttgaaatggtcttgtccaatgatattgcctcttctagtaatgccttcaatgacaccgttcattacaatccttctgatctctccggttgggctcagagcatgctctcggatcttaattactacccggatcttgacccgaaccggatttgcgatctgagaccaatcacagacgacgatgagtgttgcagtagcaatagtaacagcaacaagaggattcgactcggtccttggtgtgactcagtgaccagcgagtcaactcgttccgtggtgcttatcgaggagacaggagttagactcgttcaggcgctagtggcctgcgccgaggcggttcagctggagaatctgagcctcgcggatgctctcgtcaagcgcgtgggattactcgcggcttctcaagccggagccatggggaaagtcgctacctacttcgccgaagccctagctcgtcgaatttaccggattcatccttccgccgccgccattgatccttccttcgaagagattcttcagatgaacttctacgactcgtgtccctacctgaaattcgctcatttcacggccaatcaggcgattctagaagctgttacgacgtcgcgtgtcgtacacgtaatcgatctagggcttaatcaaggtatgcaatggccggcgttaatgcaagccttagctctccgacccggtggtccaccgtcgtttcgtctcaccggcgttgggaatccgtcgaatcgagaagggattcaagagttaggttggaagctagctcagctggctcaagccatcggcgtcgaattcaaattcaatggtctaacgacggagaggttatccgatttagaaccggatatgttcgagacccgaaccgaatcggagactctagtggttaattcggttttcgagcttcacccggttttatcccaacccggttcgatcgaaaagctgttagcgacggttaaggcggttaaaccgggtctcgtaacagtggtggaacaagaagcgaaccataacggtgacgttttcttagaccggtttaacgaagcgcttcactattactcgagcttgttcgactcgctcgaagatggtgttgtgataccgagtcaagaccgagtcatgtcggaggtttacttagggagacagatattgaacttggtggcgacggaaggaagcgataggatcgagcgacacgagacgctggctcagtggcgaaaacgtatgggatccgccgggtttgacccggttaacctcggatcagacgcgtttaagcaagcgagtttgctattggcgttatctggcggtggagatggatacagagtggaggagaacgacggaagcctaatgcttgcgtggcaaacgaaacctctaatcgctgcatcggcgtggaaactagcggcggagttgcggcggtagatacgtcgtcataaagaggagaagaaaaaagacttagcgaacgtgaccttatgtttttattttactttaacttaccccagtagtttcgttttgtgacaatttcgcccgaaatattccgtgccttatacttttgggacccagttggttcgttggtcgtggagattcgagaacgaggaacatgtgtgtatgtaacaacagcacgagcaagtgttttcatagtttgaataaatatgaaagaaatgacgtttatttt

SEQ ID NO: 952 - protein, 523 aa, Arabidopsis thaliana
  G3009,SCR domain coordinates 228-293,350-437,441-515
MKRSHQETSVEEEAPSMVEKLENGCGGGGDDNMDEFLAVLGYKVRSSDMADVAQKLEQLEMVLSNDIASSSNAFNDTVHYNPSDLSGWAQSMLSDLNYYPDLDPNRICDLRPITDDDECCSSNSNSNKRIRLGPWCDSVTSESTRSVVLIEETGVRLVQALVACAEAVQLENLSLADALVKRVGLLAASQAGAMGKVATYFAEALARRIYRIHPSAAAIDPSFEEILQMNFYDSCPYLKFAHFTANQAILEAVTTSRVVHVIDLGLNQGMQWPALMQALALRPGGPPSFRLTGVGNPSNREGIQELGWKLAQLAQAIGVEFKFNGLTTERLSDLEPDMFETRTESETLVVNSVFELHPVLSQPGSIEKLLATVKAVKPGLVTVVEQEANHNGDVFLDRFNEALHYYSSLFDSLEDGVVIPSQDRVMSEVYLGRQILNLVATEGSDRIERHETLAQWRKRMGSAGFDPVNLGSDAFKQASLLLALSGGGDGYRVEENDGSLMLAWQTKPLIAASAWKLAAELRR

SEQ ID NO: 953 - DNA, 1863 bp, Arabidopsis thaliana
  G3012,family:HLH/MYC
ctctgggttttaattcaaaaagtgaagttggttaccattgtcttgtacgatcgtatattcccgatatgatttgttttgacagagcaactgctttgtatatatatgccaaatatctctctctctctccctctctccttgcatcaatttataagtaagaccaaaagagatcaccaaaactcaggcttcttgtttggcttttcttattgttgattgagagagtgagagtaagagagagagagagagagagagagtgagagagagagagagagagagtgagatgatgatgatgagaggtggtgagagagtgaaggagtttcttcgaccctttgtcgattccagaacttgggacttatgtgttatctggaaactcggtgatgatccttctaggtttattgaatgggtgggatgctgctgcagtggttgttatattgataagaatataaagcttgaaaactcagaagaaggaggaactgggagaaaaaagaaggcttctttctgtagagatgaccacaacaagcatcgtataagaaccttagcttgtgaagcgctttctcgttttcctctcttcatgcctctctatcccgggattcatggagaagtagtgatgtcaaaatctccaaagtggttggttaattcaggatctaaaatggaaatgttcagcactcgtgttcttgttcctgtgagtgatggtctcgttgagctgttcgctttcgatatgagaccgtttgatgaaagcatggtgcatttgatcatgtcgcgttgtaccaccttctttgaaccattccctgaacaaaggctgcagttcaggatcattccccgagcagaggaatctatgagtagcggtgtgaatctcagcgttgagggcggcggatcatcaagtgtttccaatccctccagtgaaactcagaatcttttcggcaattacccgaatgctagttgtgtggaaattctcagggaggaacaaacaccgtgtttgataatgaacaaggaaaaggatgttgtggtgcaaaatgccaacgattccaaagctaataagaagctgcttcctacggaaaacttcaaatcaaagaaccttcattcagagaggaaaagaagagagagaattaatcaggccatgtatggtctaagagccgtagtccctaaaatcacaaagttgaacaaaattggaattttcagtgatgctgttgattacatcaatgaactgctagtggagaagcagaaacttgaagatgagcttaaaggaatcaatgagatggaatgcaaagaaatcgctgcagaggaacaatctgcaatagctgatccagaagctgaaagagtttcctctaaaagcaacaagagagtgaagaaaaacgaggtgaaaattgaagtccacgagactggtgagcgagatttcttgattcgggttgtgcaggaacataaacaagatggattcaagaggttgatagaagctgtagatttatgtgaacttgagatcattgacgtcaatttcaccagactcgatctcacagtcatgaccgttctcaatgtcaaggcgaacaaagacgggattgcatgtggaatattgagagatttactgctcaagatgatgataacttcaatatgaaaactcagtaaaacagagtacataacctcaaaaggtcaaatgttttgtttgcttcagtcacaagttactgctagagatatgatttctcacaagcttttaggtgacagtttacatgtttgaaactatacattcttctggtttgtcattgggttttcattaagatctttcacaaatataattctaaagggtcgtcgtccctaagaactaagaaaaacaaaacacaacaacttgagtttaatttattggtttcaatgtaaaaa

SEQ ID NO: 954 - protein, 441 aa, Arabidopsis thaliana
  G3012,HLH/MYC domain coordinates 257-314
MMMMRGGERVKEFLRPFVDSRTWDLCVIWKLGDDPSRFIEWVGCCCSGCYIDKNIKLENSEEGGTGRKKKASFCRDDHNKHRIRTLACEALSRFPLFMPLYPGIHGEVVMSKSPKWLVNSGSKMEMFSTRVLVPVSDGLVELFAFDMRPFDESMVHLIMSRCTTFFEPFPEQRLQFRIIPRAEESMSSGVNLSVEGGGSSSVSNPSSETQNLFGNYPNASCVEILREEQTPCLIMNKEKDVVVQNANDSKANKKLLPTENFKSKNLHSERKRRERINQAMYGLRAVVPKITKLNKIGIFSDAVDYINELLVEKQKLEDELKGINEMECKEIAAEEQSAIADPEAERVSSKSNKRVKKNEVKIEVHETGERDFLIRVVQEHKQDGFKRLIEAVDLCELEIIDVNFTRLDLTVMTVLNVKANKDGIACGILRDLLLKMMITSI

SEQ ID NO: 955 - DNA, 713 bp, Arabidopsis thaliana
  G3021,family:HLH/MYC
tctctttctttgtctctctcatattctaagtttgctatatatgtaactttctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatgttttttttgttgtctttaaacgaaaatcatctgtgtttttttttttctcttgatttctttaagaacaagagcatgtattatagtgtttttcttttttccttttctt

SEQ ID NO: 956 - protein, 158 aa, Arabidopsis thaliana
  G3021,HLH/MYC domain coordinates 91-148
MERQIINRKKRVFSLEPNKNPSAVFTRKYTSHLVPALKKLNMNKNSSKQTVKHEVDMALALSAQEFAWSRFLLQKLSSSSNPTTTTSSSSDGIRILERPDKEGGNEEGGIEERLRELKKLLPGGEEMNVEEMLSEIGNYIKCLELQTIALKSIVQDST

SEQ ID NO: 957 - DNA, 802 bp, Arabidopsis thaliana
  G3023,family:HLH/MYC
atcatggtctatgtgaaacaattcaggaataaaaaaagaaatggagccgagccattcaaacacaggtcaatcaagatctgtagatcgcaaaacggttgagaaaaatagaaggatgcaaatgaagtctctctactcagaactcatctctcttcttcctcatcattcttctacggagcctttaacactacctgatcagctagatgaagctgcaaactacatcaagaagctacaagtgaacgtggagaaaaagagagaaaggaaaaggaacctcgttgcgactacaactttggagaaactgaattccgtcggatcttcatcggtttcgtcgagcgtcgatgtctccgtgccaagaaagctgccaaaaatcgagattcaagaaactggttccatttttcacatctttcttgtgacaagcttggaacacaagtttatgttttgtgagatcattcgtgttctcaccgaggaattaggagctgagatcactcatgctggatactccattgttgatgatgctgtcttccacacccttcactgcaaggtggaagaacacgattatggagctaggagtcaaattcctgaaagactggagaagattgtgaacagtgttcactaatattgattccttgttcctttattaaaaaaaaaagttctatgtttttgttccttttcttgaattatttttggtgttagctagattccttttcttgaattgtatcatgtgctgtgagagtgatgtttcatttgtaagcataatatatacttttctctacttaaagctgtgaaatatattttgttttttggt

SEQ ID NO: 958 - protein, 190 aa, Arabidopsis thaliana
  G3023,HLH/MYC domain coordinates 8-68
MEPSHSNTGQSRSVDRKTVEKNRRMQMKSLYSELISLLPHHSSTEPLTLPDQLDEAANYIKKLQVNVEKKRERKRNLVATTTLEKLNSVGSSSVSSSVDVSVPRKLPKIEIQETGSIFHIFLVTSLEHKFMFCEIIRVLTEELGAEITHAGYSIVDDAVFHTLHCKVEEHDYGARSQIPERLEKIVNSVH

SEQ ID NO: 959 - DNA, 1202 bp, Arabidopsis thaliana
  G3032,family:GARP
gtaacaacgcagagtacgcggggaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaa

SEQ ID NO: 960 - protein, 346 aa, Arabidopsis thaliana
  G3032,GARP domain coordinates 285-333
MTNLDEFLEELSSIESHSQKIVKIDEHLKKLDEETKEDEDEDAAKIIQDRSTAREAEIALLMDLRQNFLPPPSMSSSSLQPPSSSTLAPSSSSSLQPPAPLIDFFRSSVSYSHQPPSSSTLATSSSPSLQPPSMSSSSLQPPASLREFFTSSVSYSHQPSSSSTLATSSFFPSSMPYSVRPPDSSDRPSLREFFPSSPSSSIQPPESSSSKRARLSNIFPSPLSSSPSPFVNPFLRPQAQEPTIPNFINPIPQISPGLPALFPNPNPNPNPNPIPNPIRNPDLVWTNRLQLVFDDAVVRLGGLFSATPKAINELISEEGLTGDQIRSHLQVLRDRQKAIADKLALE

SEQ ID NO: 961 - DNA, 1253 bp, Arabidopsis thaliana
  G3034,family:GARP
gcttaaaggtctctttcatggagctgtttcctgctcagcccgatttatccttacaaataagtccaccaaacagtaaaccatcatcgacatggcagagaagaagatcaacaacagatcaagaagatcatgaagaactcgatttagggttttggagaagagctcttgattcaagaacatcttctctcgtctctaattccacctcaaaaacaatcaatcatccattccaagacctctcgctctctaacatctctcatcatcaacaacaacaacaacatcatcatccacaacttctccctaattgcaacagctctaacatcttgacctctttccaatttccgacacagcagcaacaacaacacttacaagggtttcttgctcacgaccttaatactcacttaagaccaataagaggaataccactttaccacaaccctcctccacatcatcatcctcaccgtccgccaccgccatgtttccctttcgacccgtcgtctctaataccctcttcctccacttcctcgccggctctaaccggaaacaacaatagctttaatactagtagcgttagtaaccctaattaccacaatcatcatcaccagactctaaacagagccagattcatgccaagattcccagctaaacgaagcatgagagctcctaggatgcgatggaccaccactcttcatgcccggttcgttcacgccgttgaattactcggtggccatgaaagagcaacacctaaatcagttcttgagctcatggatgtcaaagatctaaccttggctcatgttaagtcccatttacagatgtacagaacagtgaagacaaccgacaaagcagcagcttcgtcaggacaatctgatgtctatgaaaatggatcatcaggagataataactcagacgactggatgttcgatatgaatagaaaatcgagagatagcgaggaattgacgaatcctctagagaaatcaaatggtctatggaccaattcttccggagaagcacgtttgcatgggaagttaatcgataatgttgcagaaattatgctaccttctgagaaggaactagatggaaagtgctcaagttatgagagaatatcatcagaagagatgagctcatcaagcatctcgggaacaagccctttcaagccaaatcttgagtttactctgggtcgatctcactaaatttattgttgtagctaggtagtaattaattagtatcaattaacttatattttggctactgactagttt

SEQ ID NO: 962 - protein, 388 aa, Arabidopsis thaliana
  G3034,GARP domain coordinates 218-266
MELFPAQPDLSLQISPPNSKPSSTWQRRRSTTDQEDHEELDLGFWRRALDSRTSSLVSNSTSKTINHPFQDLSLSNISHHQQQQQHHHPQLLPNCNSSNILTSFQFPTQQQQQHLQGFLAHDLNTHLRPIRGIPLYHNPPPHHHPHRPPPPCFPFDPSSLIPSSSTSSPALTGNNNSFNTSSVSNPNYHNHHHQTLNRARFMPRFPAKRSMRAPRMRWTTTLHARFVHAVELLGGHERATPKSVLELMDVKDLTLAHVKSHLQMYRTVKTTDKAAASSGQSDVYENGSSGDNNSDDWMFDMNRKSRDSEELTNPLEKSNGLWTNSSGEARLHGKLIDNVAEIMLPSEKELDGKCSSYERISSEEMSSSSISGTSPFKPNLEFTLGRSH

SEQ ID NO: 963 - DNA, 582 bp, Arabidopsis thaliana
  G3037,family:NAC
atggacatttctgcgcagagatttgccatgaacggaagaagcatgagactccctcccgggtttcggttcgatcccgatgatgaagatcttgtgttcgagtatctcgccaagaaggtcctccaccgtccaatggacttcgatctccctgagctccgttcttgcaatgttgatccatgggacttgctaggagagaagaacaaggaagtgtattacttcgtgaagaaggaagagcgagagaggaagggaagagagacgttatccggttattgggaagagtgtgaagaagaggaagtaatggaggctggtggtcgtgattgtattcatttagaaggaaggagaaagacatttgctttctttattggaaaaaaacctcgagggacaataactccatggatcatgtacgagttccgacttctttcctctagagctacaaggtggtcatcgtcccctctacctcggggtgaggtaggaaaatggagggcggtgaaagtcgtagtgaaggaagagaatgatgaagagatggtggaggatgagcacgagtctgacgagtctgatggcgaggaagttattcaaagccggtga

SEQ ID NO: 964 - protein, 193 aa, Arabidopsis thaliana
  G3037,NAC domain coordinates 15-142
MDISAQRFAMNGRSMRLPPGFRFDPDDEDLVFEYLAKKVLHRPMDFDLPELRSCNVDPWDLLGEKNKEVYYFVKKEERERKGRETLSGYWEECEEEEVMEAGGRDCIHLEGRRKTFAFFIGKKPRGTITPWIMYEFRLLSSRATRWSSSPLPRGEVGKWRAVKVVVKEENDEEMVEDEHESDESDGEEVIQSR

SEQ ID NO: 965 - DNA, 744 bp, Arabidopsis thaliana
  G3040,family:NAC
atgaagattcttccggttggatcacggttttgtccgacggatctagggttggtgaggctttatcttcgaaacaaggtggagagaaatcagagcagtttcataacaactatggacatccaccaagactacccttggcttcttcctcacgtaaacaatcctttgttcaataacaacgagtggtactactttgttccgcttactgaacgaggtggcaagatattaagcgtacaccggaaggtagccgcaagaggaggaagcgaaggcggcacttggagaagcaacgatgggaaaaaagagatcaaggacggacacatgcaaaagggtgatgggttacgagcagtctttcacagtgatgacctccaaaaggttgtcttgtgtcggatccgatacaagaaagaggcgaacgtcaacgagtttggactcgttaaccatcaggctcatcagactcaggtggcggagaacaccaacaacatcttacggaaccaacttgagatgatgctagagggacaagaagaccgtgagcagaaagaagaggctgatttaaccggttttgctgatagccttgagacgatgctagagggacaagaagatcatgagcagccagaagatgctgatttaaccggttttgctgatagccttgagacgatgctagagggacatgaagatcgtgagcagccagaagaggctgaattaaccggttttgctaatgatgaccttgagacgatgatgctagatggagaataa

SEQ ID NO: 966 - protein, 247 aa, Arabidopsis thaliana
  G3040,NAC domain coordinates 4-144
MKILPVGSRFCPTDLGLVRLYLRNKVERNQSSFITTMDIHQDYPWLLPHVNNPLFNNNEWYYFVPLTERGGKILSVHRKVAARGGSEGGTWRSNDGKKEIKDGHMQKGDGLRAVFHSDDLQKVVLCRIRYKKEANVNEFGLVNHQAHQTQVAENTNNILRNQLEMMLEGQEDREQKEEADLTGFADSLETMLEGQEDHEQPEDADLTGFADSLETMLEGHEDREQPEEAELTGFANDDLETMMLDGE

SEQ ID NO: 967 - DNA, 1871 bp, Arabidopsis thaliana
  G3041,family:NAC
ttatttcgaaatcattgttttgctctttcttttgattcgaattcgacagaacagctcttttaagttattcataaaccttgtgtttgagttttggtccatcgagtatatgggtcgtggctcagtaacatcgctcgctcctgggtttcgttttcatcccacagacgaagaactcgttcgttactatctgaaacgaaagatctgcaataaaccttttaagttcgatgctatctctgttaccgatgtatacaaatctgagccttgggatctcccagacaagtcgaggctgaaaagtagagacttggagtggtacttcttcagtatgcttgataagaagtatagaaatggatcaaagacgaatcgtgcgactgagatgggatattggaagactacagggaaagatcgagagattcttaatggttcaaaagtcgttgggatgaagaagactcttgtttatcacaaaggtcgagctcctcgtggcgaaagaaccaattgggttatgcatgagtatcggttggttgatcaagaccttgataaaactggtgttcaccaagatgcgtttgtgctttgtaggatttttcagaagagtggctccggacctaaaaatggagagcagtacggtgctccgtttgttgaggaggagtgggaggaggaggatgatatgacatttgtacctgaccaagaagatcttggaagtgaagatcatgtttatgtccatatggatgacattgatcagaagtctgaaaactttgtggtctatgatgccattcctattccgttaaactttattcacggggagtcgagcaataatgttgaaacaaactactcagactccataaactatatacaacaaacaggaaactatatggactctggtggctactttgagcaaccagcagaatcttatgagaaagatcagaagcctatcatccgtgaccgtgatggtagccttcaaaatgaaggaattggatgtggggtccaggacaagcactcggaaactttgcaatcttctgacaacatctttgggactgatacatcatgctacaatgattttccagttgagagcaactatttgattggtgaggcgtttctggatccgaacagtaatcttctggagaatgatggtctgtacctggaaacaaatgatctcagtagtactcagcaagatggtttcgactttgaagattatcttaccttctttgatgaaacttttgatccttcgcaactgatgggaaatgaagatgtttttttcgatcaagaagagctctttcaagaggttgagactaaggaactagagaaagaggagacttcaagaagcaaacatgtggtggaagaaaaggaaaaggatgaagcatcttgttcaaaacaagttgatgcagatgcaacagagtttgagccagattacaagtacccgttactaaagaaggcaagccacatgttgggtgctattcctgctccgcttgcaaatgcttctgagttccctacaaaggatgcagctatccggttacacgcagcacaatcatcaggttcagttcatgtaaccgcaggtatgatcacgatatcagacagcaacatgggctggtcatacggcaaaaacgagaaccttgacttgatcctttctttggggttggtccaagggaataccgcccccgaaaaatcagggaatagttcagcatgggcaatgttaatattcatgtgtttctgggttcttctactctcagttagtttcaaagtgagcattttggtctcttccaggtgataggtaaccctttcttgttcaaacaagacttttgtgtttgtacattgatatagatgaacttgcagtgttcaatgttttattctctaataatattgaataaaccccatattctatc

SEQ ID NO: 968 - protein, 549 aa, Arabidopsis thaliana
  G3041,NAC domain coordinates 8-136
MGRGSVTSLAPGFRFHPTDEELVRYYLKRKICNKPFKFDAISVTDVYKSEPWDLPDKSRLKSRDLEWYFFSMLDKKYRNGSKTNRATEMGYWKTTGKDREILNGSKVVGMKKTLVYHKGRAPRGERTNWVMHEYRLVDQDLDKTGVHQDAFVLCRIFQKSGSGPKNGEQYGAPFVEEEWEEEDDMTFVPDQEDLGSEDHVYVHMDDIDQKSENFVVYDAIPIPLNFIHGESSNNVETNYSDSINYIQQTGNYMDSGGYFEQPAESYEKDQKPIIRDRDGSLQNEGIGCGVQDKHSETLQSSDNIFGTDTSCYNDFPVESNYLIGEAFLDPNSNLLENDGLYLETNDLSSTQQDGFDFEDYLTFFDETFDPSQLMGNEDVFFDQEELFQEVETKELEKEETSRSKHVVEEKEKDEASCSKQVDADATEFEPDYKYPLLKKASHMLGAIPAPLANASEFPTKDAAIRLHAAQSSGSVHVTAGMITISDSNMGWSYGKNENLDLILSLGLVQGNTAPEKSGNSSAWAMLIFMCFWVLLLSVSFKVSILVSSR

SEQ ID NO: 969 - DNA, 543 bp, Arabidopsis thaliana
  G3054,family:Z-C3H
atgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcaggtaaagctacggcctttttcatctattag

SEQ ID NO: 970 - protein, 180 aa, Arabidopsis thaliana
  G3054,Z-C3H domain coordinates 77-96,149-168
MSHRRDYGSDAVHVRITHDPPPENCFPNSGDSSVWATEDDYSRVWAINSDGAESPSKKTRSSSSSEIGKSFFKTKLCFKFRAGTCPYSASSCHFAHSAEELRLPPPPPPNWQETVTEASRNRESFAVSLGPRGNVAQTLKSPNWKTRICNKWQTTGYCPFGSHCHFAHGPSGKATAFFIY

SEQ ID NO: 971 - DNA, 1155 bp, Arabidopsis thaliana
  G3055,family:Z-C3H
atgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatga

SEQ ID NO: 972 - protein, 384 aa, Arabidopsis thaliana
  G3055,Z-C3H domain coordinates 97-115,178-197,266-287
MSHHRRDSGGDVVHVIPTNNPPPDNWFPNLGDSAVWATEDDYNRAWAMNPDNTSGDNNGPPNKKTRGSPSSSSATTTSAASNRTKAIGKMFFKTKLCCKFRAGTCPYITNCNFAHTVEELRRPPPNWQEIVAAHEEERSGGMGTPTVSVVEIPREEFQIPSLVSSTAESGRSFKGRHCKKFYTEEGCPYGESCTFLHDEASRNRESVAISLGPGGYGSGGGGGSGGGSVGGGGSSSNVVVLGGGGGSGSGSGIQILKPSNWKTRICNKWEITGYCPFGAKCHFAHGAAELHRFGGGLVEEEGKDGVSPNPDTKQTVQNPKGLSDTTTLLSPGVPHNADASYHTGVALQRASSAVTQKPGIRTHQKWKGPAKISRIYGDWIDDIE

SEQ ID NO: 973 - DNA, 1962 bp, Arabidopsis thaliana
  G306,family:SCR
atggcggaatccggcgatttcaacggtggtcaacctcctcctcatagtcctctgagaacaacttcttccggtagtagcagcagcaacaaccgtggtcctcctcctcctcctcctcctcctttagtgatggtgagaaaaagattagcttccgagatgtcttctaaccctgactacaacaactcctctcgtcctcctcgccgtgtctctcaccttcttgactccaactacaatactgtcacaccacaacaaccaccgtctcttacggcggcggctactgtatcttctcaaccaaacccaccactctctgtttgtggcttctctggtcttcccgtttttccttcagaccgtggtggtcggaatgttatgatgtccgtacaaccaatggatcaagactcttcatcttcttctgcttcacctactgtatgggttgacgccattatcagagaccttatccattcctcaacttcagtctctattcctcaacttatccaaaacgttagagacattatcttcccttgtaacccaaatctcggtgctcttcttgaatacaggctccgatctctcatgctccttgatccttcctcttcctctgacccttctcctcaaactttcgaacctctctatcagatctccaacaatccttctcctccacaacagcaacagcagcaccaacaacaacaacaacagcataagcctcctcctcctccgattcagcagcaagaaagagaaaattcttctaccgatgcaccaccgcaaccagagacagtgacggccactgttcccgccgtccaaacaaatacggcggaggctttaagagagaggaaggaagagattaagaggcagaagcaagacgaagaaggattacaccttctcacattgctgctacagtgtgctgaagctgtctctgctgataatctcgaagaagcaaacaagcttcttcttgagatctctcagttatcaactccttacgggacctcagcgcagagagtagctgcttacttctcggaagctatgtcagcgagattactcaactcgtgtctcggaatttacgcggctttgccttcacggtggatgcctcaaacgcatagcttgaaaatggtctctgcgtttcaggtctttaatgggataagccctttagtgaaattctcacactttacagcgaatcaggcgattcaagaagcatttgagaaagaagacagtgtacacatcattgacttggacatcatgcagggacttcaatggcctggtttattccacattcttgcttctagacctggaggacctccacacgtgcgactcacgggacttggtacttccatggaagctcttcaggctacagggaaacgtctttcggatttcacagataagcttggcctgccttttgagttctgccctttagctgagaaagttggaaacttggacactgagagactcaatgtgaggaaaagggaagctgtggctgttcactggcttcaacattctctttatgatgtcactggctctgatgcacacactctctggttactccaaagattagctcctaaagttgtgacagtagtggagcaagatttgagccacgctggttctttcttaggaagatttgtagaggcaatacattactactctgcactctttgactcactgggagcaagctacggcgaagagagtgaagagagacatgtcgtggaacagcagctattatcgaaagagatacggaatgtattagcggttggaggaccatcgagaagcggtgaagtgaagtttgagagctggagggagaaaatgcaacaatgtgggtttaaaggtatatctttagctggaaatgcagctacacaagcgactctactgttgggaatgtttccttcggatggttacactttggttgatgataatggtacacttaagcttggatggaaagatctttcgttactcactgcttcagcttggacgcctcgttcttag

SEQ ID NO: 974 - protein, 653 aa, Arabidopsis thaliana
  G306,SCR domain coordinates 370-435,486-573,576-649
MAESGDFNGGQPPPHSPLRTTSSGSSSSNNRGPPPPPPPPLVMVRKRLASEMSSNPDYNNSSRPPRRVSHLLDSNYNTVTPQQPPSLTAAATVSSQPNPPLSVCGFSGLPVFPSDRGGRNVMMSVQPMDQDSSSSSASPTVWVDAIIRDLIHSSTSVSIPQLIQNVRDIIFPCNPNLGALLEYRLRSLMLLDPSSSSDPSPQTFEPLYQISNNPSPPQQQQQHQQQQQQHKPPPPPIQQQERENSSTDAPPQPETVTATVPAVQTNTAEALRERKEEIKRQKQDEEGLHLLTLLLQCAEAVSADNLEEANKLLLEISQLSTPYGTSAQRVAAYFSEAMSARLLNSCLGIYAALPSRWMPQTHSLKMVSAFQVFNGISPLVKFSHFTANQAIQEAFEKEDSVHIIDLDIMQGLQWPGLFHILASRPGGPPHVRLTGLGTSMEALQATGKRLSDFTDKLGLPFEFCPLAEKVGNLDTERLNVRKREAVAVHWLQHSLYDVTGSDAHTLWLLQRLAPKVVTVVEQDLSHAGSFLGRFVEAIHYYSALFDSLGASYGEESEERHVVEQQLLSKEIRNVLAVGGPSRSGEVKFESWREKMQQCGFKGISLAGNAATQATLLLGMFPSDGYTLVDDNGTLKLGWKDLSLLTASAWTPRS

SEQ ID NO: 975 - DNA, 747 bp, Arabidopsis thaliana
  G3060,family:Z-C3H
atggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctag

SEQ ID NO: 976 - protein, 248 aa, Arabidopsis thaliana
  G3060,Z-C3H domain coordinates 42-61,219-237
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 977 - DNA, 1672 bp, Arabidopsis thaliana
  G3063,family:Z-C2H2
tctttgaaacatgccggttgatttagataattcctctacagtttccggcgatgcaagcgtctcatcgaccggaaaccaaaatctaactcctaaatccgtcgggaagaagaaacggaatcttcctggaatgcctgatccagacgctgaagtgatagctttgtcacctaaaacacttatggcaacgaatcgattcgtttgcgaaatctgtaacaaaggttttcaacgtgaccagaatcttcagcttcatcgtcgtggtcacaatcttccatggaaacttcgacagagatcgactaaagaagtgaggaagaaggtttatgtttgtcctgtttctggctgtgttcatcatgacccttcacgtgctcttggagatcttactggaatcaagaaacacttttgtcggaaacacggcgagaagaaatggaagtgtgagaaatgttctaagaagtatgctgttcaatcagattggaaagctcattcgaagatttgtggcaccaaggagtataaatgcgattgtggaactctgttttctaggagagatagctttataacgcatagagccttttgtgatgccttggctgaagagagtgcgaagaatcatactcaaagcaagaaactttatccagaaactgtcactaggaagaatcctgaaattgagcaaaaatctccagcagctgttgagtcttctccgtcattaccgccttcttctccgccatcggttgctatagctccggcaccggctatttcggttgagactgagtctgtcaaaatcatatcttcctctgttttgccgattcagaattctccagaatctcaagaaaacaacaatcatcctgaagtcattattgaggaagcttcaagaacgatcgggttcaatgttagctcatcggatctaagcaatgatcacagtaacaacaatggtggatacgcaggtttgtttgtatcatcaacagcttcgcctagtttatatgcttcctcaaccgcttctccaagtctattcgcaccatcgtcctccatggaacccatctctctctgtctctcgacgaacccttctttgttcggaccaacaatacgagatccgccacatttcctaactcctctccctcctcaaccggcaatgtcagctactgcattgctccaaaaagctgcacaaatgggttccacgggatcaggaggttcgttgcttcgcgggttaggcatagtttcaactacttcttcatctatggaactcagcaatcatgatgcattgtcattagctcctggtcttggacttggactaccttgtagcagcggtggtagcggatcgggtctaaaagagctcatgatggggaattcatcggtgtttggtccgaaacagacgacactagactttcttggattaggaagagctgttggtaatggtggtaataccggaggtggattgtctgctctgttaacttctataggtggtggaggtggaatcgatctgtttggatcaggggagttttcaggcaaagacattggaagaagttcgtaagagagacaaaaggcatgaacgtagtagaccagtgtagtatatagttcatcaagtttgtttcaggttttagatgttttggtatcttgttttagtgaaagctttagttttattcccaagtgggttttctctcaagtacataaatctcctagcaacaacaac

SEQ ID NO: 978 - protein, 500 aa, Arabidopsis thaliana
  G3063,Z-C2H2 domain coordinates 63-83,139-159
MPVDLDNSSTVSGDASVSSTGNQNLTPKSVGKKKRNLPGMPDPDAEVIALSPKTLMATNRFVCEICNKGFQRDQNLQLHRRGHNLPWKLRQRSTKEVRKKVYVCPVSGCVHHDPSRALGDLTGIKKHFCRKHGEKKWKCEKCSKKYAVQSDWKAHSKICGTKEYKCDCGTLFSRRDSFITHRAFCDALAEESAKNHTQSKKLYPETVTRKNPEIEQKSPAAVESSPSLPPSSPPSVAIAPAPAISVETESVKIISSSVLPIQNSPESQENNNHPEVIIEEASRTIGFNVSSSDLSNDHSNNNGGYAGLFVSSTASPSLYASSTASPSLFAPSSSMEPISLCLSTNPSLFGPTIRDPPHFLTPLPPQPAMSATALLQKAAQMGSTGSGGSLLRGLGIVSTTSSSMELSNHDALSLAPGLGLGLPCSSGGSGSGLKELMMGNSSVFGPKQTTLDFLGLGRAVGNGGNTGGGLSALLTSIGGGGGIDLFGSGEFSGKDIGRSS

SEQ ID NO: 979 - DNA, 1191 bp, Arabidopsis thaliana
  G3064,family:Z-C2H2
atgagtttgttctgtaattcaatcgaaaccctttatccaaaaccattcctttcacacaaatctcacttctttaccttctccaattccaaattccaaaaccctaaattcacaagcttcccacttcgtcaccaatggcggatcgaatcatgtctgaaatcagcatcttcatcagaaatcgatatggtaagaaacaaagaaggtatctttgcaccaaaggagaagaaagttgtagtcttatgggacttagacaacaaaccaccacgaggtccaccatacgaagccgcaacagctctccgtaaagtcgctgagaaactcggccgagtcgtcgaaatctccgcttacgcaaatcgtcatgcttttatccatttacctcattgggtcgtcgaagagagacgagaaaggaggaaccttgatttcatggagaggaaaggagaagtgactccaattgatccgtacatttgtggtgtttgtggtcgcaagtgtaaaaccaatcttgatttgaagaaacatttcaagcagcttcatgagagggagagacagaagaaagttaataggatgagatctttgaaaggtaagaaacgtcagaagtttaaggagcgttatgtttcagggaatgagaagtataatgaggctgcgaggagtttgttgactcctaaagttggatatggtttagaggctgagctacgtcgagcaggggtttatgttaagacggttgaggataagcctcaggctgcggattgggcggttaagagacagatacaacattcaatgactagagggattgattggttggttttggtgtcggatgataaggatttttctgatatgttgaggaaagctagagaggctgatcttgggactttggttgttagtgatatggatagagcattgggaaggcatgctgatttgtgggtgccttggagtggtgttgagaagggagagattggtgagaaggatttgattccggggaagagaccaaggtttgaggaggatgaggtgggatttggtggtaatgatgagttgttttcgttgtcgtatgatgaggatgagaaggcggagatgacggtggagagtgatgggtttgggaggtttaatgtatcggcgttttcggaagatgaatgggtggaggatgaaggagactttgtgttgagtgatagtagtgatgatgatagtgatgatgagcttttctga

SEQ ID NO: 980 - protein, 396 aa, Arabidopsis thaliana
  G3064,Z-C2H2 domain coordinates 154-175
MSLFCNSIETLYPKPFLSHKSHFFTFSNSKFQNPKFTSFPLRHQWRIESCLKSASSSEIDMVRNKEGIFAPKEKKVVVLWDLDNKPPRGPPYEAATALRKVAEKLGRVVEISAYANRHAFIHLPHWVVEERRERRNLDFMERKGEVTPIDPYICGVCGRKCKTNLDLKKHFKQLHERERQKKVNRMRSLKGKKRQKFKERYVSGNEKYNEAARSLLTPKVGYGLEAELRRAGVYVKTVEDKPQAADWAVKRQIQHSMTRGIDWLVLVSDDKDFSDMLRKAREADLGTLVVSDMDRALGRHADLWVPWSGVEKGEIGEKDLIPGKRPRFEEDEVGFGGNDELFSLSYDEDEKAEMTVESDGFGRFNVSAFSEDEWVEDEGDFVLSDSSDDDSDDELF

SEQ ID NO: 981 - DNA, 1062 bp, Arabidopsis thaliana
  G3066,family:Z-C2H2
atggaagaacaacaagaatttgagaaacccatcttcgaattccgtcctaagaagctcagaacctctcgagtttcgagaaatctcatgaagaagactggcttcagagaatctatgaatcattacgaagagctctcttgcaactacggattgagggaaaacccgaagaaaacccagaaatctttactcgatcatcgattctgtacgaggaggaggagaaataaaaagatcctgattcgatgcaaagaatgcgggaaagggtttctttacgagaaatgtctgtttaatcatctccaagtgacgcattctgaagaatctacaagaagaagcctgttttgtaggtttagtattgtgcagaggagaaaaagatcgaagagagtttccaggtacaagaagattcttcctcgattctctgtttcttcttcttcgtgtactatgtttcctgtttctgtggatgatggaggattattagaagtcgctgagtctctgattctcttgtccatgagtggtggaaagttcgtgaatggtttggaacattttggtaaagctctgggttcgactcagagaaaatttgaagacgggttattgagaaatgagcagagacttgttggtgaagctctggattcgaatccagagaagaaacttgtggggataagcagagcatctgttggaacatcgaaagagctttcgggttacttggcaaacaagaagggcagagaagatgatgaattgggtcagcagaaacaggctggagcaagaatacttagagaagaaactgataacgaacagaaacttgttcgtcaagaaactgcatttgaagattcagtatcaggatttgagatgaatatagagcatcggtgtgggctctgtcacaaggttttctcgacttatcaaactcttggtggtcatcagacgttccatagaatgagaaacaaatccaaaagtcaaaccaagagatgcagagaagaatcgatagaagctgaagctgggattaataatggttcagtgacgttgacaataagtgcagagtttgctgaaggctgtttaggtcagtacatgctttaa

SEQ ID NO: 982 - protein, 353 aa, Arabidopsis thaliana
  G3066,Z-C2H2 domain coordinates 80-101,284-306
MEEQQEFEKPIFEFRPKKLRTSRVSRNLMKKTGFRESMNHYEELSCNYGLRENPKKTQKSLLDHRFCTRRRRNKKILIRCKECGKGFLYEKCLFNHLQVTHSEESTRRSLFCRFSIVQRRKRSKRVSRYKKILPRFSVSSSSCTMFPVSVDDGGLLEVAESLILLSMSGGKFVNGLEHFGKALGSTQRKFEDGLLRNEQRLVGEALDSNPEKKLVGISRASVGTSKELSGYLANKKGREDDELGQQKQAGARILREETDNEQKLVRQETAFEDSVSGFEMNIEHRCGLCHKVFSTYQTLGGHQTFHRMRNKSKSQTKRCREESIEAEAGINNGSVTLTISAEFAEGCLGQYML

SEQ ID NO: 983 - DNA, 1296 bp, Arabidopsis thaliana
  G3067,family:Z-C2H2
atggaagcttcaagcacaagaagcgagaagaagaagaagaagaagacgatacagagagaaaacaccgatactcaaaagaaaaaaaagctacccagtgtttggttttcacttaagaaatctctcccctgcaaatctgatgtctccgatgtccacattccgagatccaaaaaagagctagctcccatatccactaagagaacaacaacctcctccggcggcggggtcggcggcaggtccggttgttcaagatccatagccaatcttaaagacgtaatccatggaaaccaacggcatttagagaagccgctttgctctagccctcgttctataggaagcagcgagtttctcaatcccattactcacgatgtaatctttagcaactccacctgcgagctcaagatcaccgccgccggagcaacagaattcgtcgggaatcttagaccagggacgccggtcaattactcttcttcacgccgtagccaaacttcgagaaaggcttcttctttagatagagaaggattagggtttcaccagagcagaagagagaatgatagagaagccgccattaacggagacaattcctctgtttcttgccataaatgcggcgagaaatttagcaaactcgaagctgcagaagctcatcatctaaccaaacacgccgtgactgagctaatggaaggagactcgtcgaggagaatagtggagataatctgcagaacaagctggttaaagacagagaatcaaggagggagaatcgatcggattttgaaagtacacaacatgcaaaaaaccttagcgagattcgaagaatacagagatacagtgaagatcagagcaagcaagttacaaaagaaacatccgagatgtatcgccgacggaaacgagcttctcaggtttcacggcaccactgtggcttgcgctttggggataaacgggtcgacgagtctgtgttcgtcggaaaagtgttgcgtttgtcggattatacgaaatgggttctcggcgaaacgggagatgaataacggaattggggtttttactgcgtcgacgagtgagagggcgtttgagtctattgtgattggagatggtggtggtggtgatcggaaggcgttgattgtgtgtcgagtgattgccgggagggttcatcggccggtggagaatgtagaggagatgggtgggttgttgagtgggtttgattcattggctggtaaagttgggttgtacacaaatgttgaggagctctatttgctcaattctcgagctttgcttccttgttttgtgctaatctgcaaaccttaa

SEQ ID NO: 984 - protein, 431 aa, Arabidopsis thaliana
  G3067,Z-C2H2 domain coordinates 198-219
MEASSTRSEKKKKKKTIQRENTDTQKKKKLPSVWFSLKKSLPCKSDVSDVHIPRSKKELAPISTKRTTTSSGGGVGGRSGCSRSIANLKDVIHGNQRHLEKPLCSSPRSIGSSEFLNPITHDVIFSNSTCELKITAAGATEFVGNLRPGTPVNYSSSRRSQTSRKASSLDREGLGFHQSRRENDREAAINGDNSSVSCHKCGEKFSKLEAAEAHHLTKHAVTELMEGDSSRRIVEIICRTSWLKTENQGGRIDRILKVHNMQKTLARFEEYRDTVKIRASKLQKKHPRCIADGNELLRFHGTTVACALGINGSTSLCSSEKCCVCRIIRNGFSAKREMNNGIGVFTASTSERAFESIVIGDGGGGDRKALIVCRVIAGRVHRPVENVEEMGGLLSGFDSLAGKVGLYTNVEELYLLNSRALLPCFVLICKP

SEQ ID NO: 985 - DNA, 882 bp, Arabidopsis thaliana
  G3074,family:CAAT
atgaggaagaagctcgatactcggttcccagctgctcgtattaaaaagattatgcaagctgatgaggatgttggcaagatagctttggcagtgcctgtcttagtctcaaaatctttggagttgttcttgcaagacctttgtgatcgtacatatgaaattacccttgaaagaggtgccaagactgtgagctcattgcacctaaaacattgtgtggaaagatataacgtgtttgattttctgagggaagttgtgagtaaggtgcctgactatggccattcccaagggcaaggacatggtgatgttaccatggatgatcgcagcatctccaagagaaggaagcccatcagcgatgaagtgaatgacagtgacgaggaatataagaaaagcaaaacgcaagagatagggagtgctaagaccagtggcaggggtggtagaggaagagggcgaggaagaggtcgtggtggacgagctgcaaaagcagccgaaagagagggtctcaaccgcgagatggaagtagaagccgccaattctggacagccaccaccagaagacaatgtcaagatgcatgcgtcagagtcatcaccacaagaggatgagaagaaaggcatcgacggcacagcagcatcgaacgaagacaccaagcaacaccttcaaagtcccaaagaaggcattgactttgatctcaacgctgaatccctcgacctaaacgagaccaaactggcaccagccacaggcacaaccacaaccacaactgcagcaacagactctgaggagtattcgggctggcctatgatggacataagcaaaatggatccagcacagcttgctagtctgggtaagaggatagacgaggatgaggaagattatgacgaagaaggctaa

SEQ ID NO: 986 - protein, 293 aa, Arabidopsis thaliana
  G3074,CAAT domain coordinates 3-86
MRKKLDTRFPAARIKKIMQADEDVGKIALAVPVLVSKSLELFLQDLCDRTYEITLERGAKTVSSLHLKHCVERYNVFDFLREVVSKVPDYGHSQGQGHGDVTMDDRSISKRRKPISDEVNDSDEEYKKSKTQEIGSAKTSGRGGRGRGRGRGRGGRAAKAAEREGLNREMEVEAANSGQPPPEDNVKMHASESSPQEDEKKGIDGTAASNEDTKQHLQSPKEGIDFDLNAESLDLNETKLAPATGTTTTTTAATDSEEYSGWPMMDISKMDPAQLASLGKRIDEDEEDYDEEG

SEQ ID NO: 987 - DNA, 621 bp, Arabidopsis thaliana
  G3075,family:CAAT
atggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggagatgttcattgagcggttttctgaagaagcttatgatagttccgtcaaggacaaaaagaaattcatccactacaaacacctctcatccgtagtgagtaacgaccagagatacgagttccttgcagatagtgttcccgagaaacttaaagcagaggccgcgttggaggaatgggaaagaggcatgacagatgcaggctga

SEQ ID NO: 988 - protein, 206 aa, Arabidopsis thaliana
  G3075,CAAT domain coordinates 111-192
MVSSKKPKEKKARSDVVVNKASGRSKRSSGSRTKKTSNKVNIVKKKPEIYEISESSSSDSVEEAIRGDEAKKSNGVVSKRGNGKSVGIPTKTSKNREEDDGGAEDAKIKFPMNRIRRIMRSDNSAPQIMQDAVFLVNKATEMFIERFSEEAYDSSVKDKKKFIHYKHLSSVVSNDQRYEFLADSVPEKLKAEAALEEWERGMTDAG

SEQ ID NO: 989 - DNA, 1046 bp, Arabidopsis thaliana
  G3080,family:bZIP-ZW2
gcattcacgaactaaccaacgaagaaagatggcgactagttcttcgagttatgggattgaacaacttcaaaaaggatgttactatgagtggatgagtgtgcaggctaaacacatagttgatctcaaagaagcactcatgagtcatcgatccaaagaagatcacaagcttgaagaactcgttggtaaaatcgtcaatgacttccaaaaatacaccgaaaaacgatctgagctctctcgccgaagctgctcaagctactttgcaccgtcgtggaactctcctctagagaacggtttactatggatgggaggatgtcgtccatcgtctttcattagagttatttactctctttgtggatcccaagccgaaacgcagctttctcagtatcttctaaagatcgatgaaaatgtcgaagtaaaccatggtggttccatgagtgatctaaacgcgtcgcagcttgcaaaaatcaatgatttgcatataaaggttatagagaaagaggacaagataacaaagaaatcggcgaatttgcaagagaatgttgcggatatgcctatagccatcgcggcttatgccacggacttgatgaatggtgacgtggtggtggaagatgctttagataagtatgaggagggcatggcggttttaatggtggaagctgataaactgaggtttgagacgcttaggaagatcgtggatgttgttacgccggttcaagcggcggagtttttgctcgcagggaaaagattacacatatcattgcacgagtggggaagagttagagaagagcaacgttttgggtgtgtacgtacggatgcagcggctgccacgggaggagcgggaaccgagaagtcaaagaggtcaagcttgttgatgtgagtttaaagttgaatatatataacttgtgttatatttgtctatgtagagataaaatcgtgtttaagtgtctttatgtgtaatatatgtatgagagagtgcggctagtttcgagatgatgcaagcataagcttttgcttttgtcttatataataacaaaagctgaaaacaa

SEQ ID NO: 990 - protein, 282 aa, Arabidopsis thaliana
  G3080,bZIP-ZW2 domain coordinates 76-106,210-237
MATSSSSYGIEQLQKGCYYEWMSVQAKHIVDLKEALMSHRSKEDHKLEELVGKIVNDFQKYTEKRSELSRRSCSSYFAPSWNSPLENGLLWMGGCRPSSFIRVIYSLCGSQAETQLSQYLLKIDENVEVNHGGSMSDLNASQLAKINDLHIKVIEKEDKITKKSANLQENVADMPIAIAAYATDLMNGDVVVEDALDKYEEGMAVLMVEADKLRFETLRKIVDVVTPVQAAEFLLAGKRLHISLHEWGRVREEQRFGCVRTDAAAATGGAGTEKSKRSSLLM

SEQ ID NO: 991 - DNA, 1536 bp, Arabidopsis thaliana
  G309,family:SCR
atgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataa

SEQ ID NO: 992 - protein, 511 aa, Arabidopsis thaliana
  G309,SCR domain coordinates 223-288,342-427,431-505
MKREHNHRESSAGEGGSSSMTTVIKEEAAGVDELLVVLGYKVRSSDMADVAHKLEQLEMVLGDGISNLSDETVHYNPSDLSGWVESMLSDLDPTRIQEKPDSEYDLRAIPGSAVYPRDEHVTRRSKRTRIESELSSTRSVVVLDSQETGVRLVHALLACAEAVQQNNLKLADALVKHVGLLASSQAGAMRKVATYFAEGLARRIYRIYPRDDVALSSFSDTLQIHFYESCPYLKFAHFTANQAILEVFATAEKVHVIDLGLNHGLQWPALIQALALRPNGPPDFRLTGIGYSLTDIQEVGWKLGQLASTIGVNFEFKSIALNNLSDLKPEMLDIRPGLESVAVNSVFELHRLLAHPGSIDKFLSTIKSIRPDIMTVVEQEANHNGTVFLDRFTESLHYYSSLFDSLEGPPSQDRVMSELFLGRQILNLVACEGEDRVERHETLNQWRNRFGLGGFKPVSIGSNAYKQASMLLALYAGADGYNVEENEGCLLLGWQTRPLIATSAWRINRVE

SEQ ID NO: 993 - DNA, 732 bp, Arabidopsis thaliana
  G3090,family:PLATZ
atggttagagaaggtgaagaagaagaagagatgatgatgatgatggcaacgaaacctgcatggcttgaaggtttaatggcggagactttcttctcaagctgtggaatccacgaaactcgccgtaaaagtgaaaagaacgttttttgcttactctgttgtctcagtgtttgtcctcactgtctcccttctcatcgctctcatcctcttcttcaggtgagacgatacgtataccacgacgtcgttcggttgagtgatcttgagaagctcatagattgttcatatgttcagccatatacaattaatggagccaaagtgatattcttaaaccaaagacaacaatcacgagctaaggtttcttcaaatgtttgcttcacttgtgatagaatccttcaagaaccattccacttttgttccctctcttgcaaggtggattatttatcatatcaaggagatgatttatcaagcattctctatagaattgatgaatcagattttacgttcgagggtttgagaatggacggacatgatcagctcggagagatatcgacgatggaggatggggaggatatactggtaatttcagatgaatctgagcaaggtaacaatagtcataagaaagagaagaagaagagcaagaagaagaagccagagagcaattacttgcctgggatggttctttcatcacttggtaatagaagaaaaggtgctcctcatagggctcctttttcataa

SEQ ID NO: 994 - protein, 243 aa, Arabidopsis thaliana
  G3090,PLATZ domain coordinates 12-147
MVREGEEEEEMMMMMATKPAWLEGLMAETFFSSCGIHETRRKSEKNVFCLLCCLSVCPHCLPSHRSHPLLQVRRYVYHDVVRLSDLEKLIDCSYVQPYTINGAKVIFLNQRQQSRAKVSSNVCFTCDRILQEPFHFCSLSCKVDYLSYQGDDLSSILYRIDESDFTFEGLRMDGHDQLGEISTMEDGEDILVISDESEQGNNSHKKEKKKSKKKKPESNYLPGMVLSSLGNRRKGAPHRAPFS

SEQ ID NO: 995 - DNA, 2312 bp, Arabidopsis thaliana
  G3101,family:Z-C2H2
gttccatctccatcctaatcttcaccttctccttgatttcgagatctctgtcaatttgttgaatctgttctttatctaattagctcaactccgagtctttgctggattttgaagcttttgtagctgaagcaaatttgtaatctgtgatggtgtatgcactgattctgggtatggtattgtactctaggatctcgtagcgagaatgccaggcattcctcttgttagtcgtgaaacctcttcttgttcaagaagcacagagcagatgtgccatgaagactcccgtctgcgtatttcggaagaggaggagattgctgctgaagagagcttggctgcctattgcaagcctgttgaactctacaatatcattcaacgccgtgctattaggaatcccttgtttcttcagcgatgtttgcattataagattgaggcaaaacataaaaggagaatacaaatgactgtattcctctcgggcgctatagatgctggggtacaaactcaaaaattattccctctgtatattttgttggcaagactcgtttctcctaagcctgtcgctgagtattctgcagtatataggttcagtcgagcatgtatcctaactggtggattgggggttgatggagttagtcaagcccaagccaactttcttctccctgatatgaatagactcgcattggaggcaaaatcaggatcactcgctatcttgtttatcagctttgctggtgcgcaaaattctcaatttggcattgattcaggcaagattcattcaggaaatataggaggacattgtttatggagcaaaatacctctgcaatcactgtatgcgtcgtggcagaaatcaccaaacatggacttgggacagagagtagacacagtctctcttgttgaaatgcagccttgcttcataaagctaaagtccatgagtgaggaaaagtgtgtctcgattcaggtgcccagcaatccactcacctcgagctctccgcagcaagtgcaagtcaccatatctgcagaagaagttgggtcaacggaaaaatctccttatagttcattttcatataatgacatctcttcctcttccttgttgcaaattatcaggttgagaacaggaaatgtagttttcaactacagatactataacaacaaattgcagaagactgaagtaactgaagacttttcttgtccattctgcttagtaaaatgtgccagtttcaagggcctgagatatcacttgccatcaacccacgatctcctcaatttcgagttttgggtaactgaagaatttcaggcggtaaatgtctccctcaagactgagacaatgatatccaaggttaatgaggatgacgttgacccaaagcagcaaactttctttttttcttccaaaaaattcagacggaggaggcaaaagagtcaggtacggagctcaaggcaagggcctcatcttggattaggttgcgaggtgctagataagactgatgatgctcattctgttagaagtgagaagagccgaataccacctggaaagcattacgaaagaattgggggtgctgagtctggtcaaagagttcctcctggcacgagtcctgcagacgtgcaatcatgtggggatccagattatgtgcagtcgatagctggaagtacaatgttgcagtttgcaaaaacgaggaaaatatctatagaacggtcggacttgaggaaccgaagcctccttcagaagagacagttcttccactctcatcgagctcagcccatggctctagaacaagtactttcggaccgggatagtgaagatgaagttgatgatgatgtggcagattttgaagatagaaggatgctcgatgatttcgttgatgtgactaaagatgagaaacagatgatgcacatgtggaactcgtttgtgaggaagcagcgagtattagcagatggtcacattccatgggcatgcgaggcattctcaagattgcacggacccatcatggttcgaacaccgcacttgatttggtgctggagagtgtttatggtgaaactgtggaaccacggtcttcttgatgcccgaaccatgaacaactgtaatacctttctcgaacagctccaaatttgaaaacccaagaaatcattaatttaagtagaaaaacaaagaaagacaagagaagaagagttttgggttctcatttaactacttttggtgttttaagagaaagaggagcatatttatgcatgaatttgtcctcatcttttttttttttttttttaattataaatgtgtacattggcttatctttgacgcttgttcttcgagtaatgctttatacatg

SEQ ID NO: 996 - protein, 631 aa, Arabidopsis thaliana
  G3101,Z-C2H2 domain coordinates 14-78
MPGIPLVSRETSSCSRSTEQMCHEDSRLRISEEEEIAAEESLAAYCKPVELYNIIQRRAIRNPLFLQRCLHYKIEAKHKRRIQMTVFLSGAIDAGVQTQKLFPLYILLARLVSPKPVAEYSAVYRFSRACILTGGLGVDGVSQAQANFLLPDMNRLALEAKSGSLAILFISFAGAQNSQFGIDSGKIHSGNIGGHCLWSKIPLQSLYASWQKSPNMDLGQRVDTVSLVEMQPCFIKLKSMSEEKCVSIQVPSNPLTSSSPQQVQVTISAEEVGSTEKSPYSSFSYNDISSSSLLQIIRLRTGNVVFNYRYYNNKLQKTEVTEDFSCPFCLVKCASFKGLRYHLPSTHDLLNFEFWVTEEFQAVNVSLKTETMISKVNEDDVDPKQQTFFFSSKKFRRRRQKSQVRSSRQGPHLGLGCEVLDKTDDAHSVRSEKSRIPPGKHYERIGGAESGQRVPPGTSPADVQSCGDPDYVQSIAGSTMLQFAKTRKISIERSDLRNRSLLQKRQFFHSHRAQPMALEQVLSDRDSEDEVDDDVADFEDRRMLDDFVDVTKDEKQMMHMWNSFVRKQRVLADGHIPWACEAFSRLHGPIMVRTPHLIWCWRVFMVKLWNHGLLDARTMNNCNTFLEQLQI

SEQ ID NO: 997 - DNA, 1374 bp, Arabidopsis thaliana
  G3102,family:Z-C2H2
atcagctctggacgttgttgattgtatttgaacaagaatgtgtaggcagaattgtcgcgcgaaatcctcaccggaggaagtgatttcaactgatgagaatctcttgatatattgtaaacctgttcgactatataacatctttcaccttcgctctctaggcaacccatcgtttctgccaagatgcttgaactacaaaattggggcaaagcgcaaaagaaagtcaagatctactgggatggtagttttcaactataaggattgtaataatacattacaaagaactgaagttagggaggattgttcttgtccattttgctctatgctatgtggtagcttcaaggggctgcaatttcatttgaattcatctcatgatttatttgaatttgagttcaagcttttggaagaataccagacagttaatgtttctgtaaaacttaattccttcatatttgaggaagaaggaagtgatgatgataaatttgagcccttctctctctgctcgaaacctcgtaagcgtagacaaagaggtggcagaaataacaccaggagacttaaagtatgctttttaccgttggattcacccagtttagctaatggcacagaaaatggaattgccctgctgaatgatggaaaccgtggtttaggatatcccgaggcaacagagcttgctggacaatttgagatgactagcaacattccaccagccatagcccactcttctctggacgctggtgctaaagttatattaacaaccgaagctgtggtccctgctactaagacaagaaagttatctgctgagcgatcagaggctagaagccacctacttcttcagaaacgccaattctatcattctcacagagtccagccaatggcgcttgagcaagtaatgtctgatcgggatagcgaggatgaagtcgatgacgatgttgcagattttgaagatcgccagatgcttgatgactttgtggatgtgaataaagatgaaaagcaattcatgcatctttggaactcgtttgtaagaaaacaaagggttatagcagatggtcatatctcttgggcatgtgaagtattttcaagattttacgagaaagagttgcactgttactcatcactcttctggtgttggagattgtttttgattaaactatggaaccatggacttgtcgactcagccaccatcaacaactgcaataccatcctcgagaattgccgtaatacctcagtcactaacaacaacaacaacagtgtggatcatcccagtgactcaaacaccaacaacaataacattgtggatcatccgaatgacataaaaaacaagaacaatgttgacaacaaggacaataacagcagagacaagtaattaaataggaaaca

SEQ ID NO: 998 - protein, 440 aa, Arabidopsis thaliana
  G3102,Z-C2H2 domain coordinates 397-440
MCRQNCRAKSSPEEVISTDENLLIYCKPVRLYNIFHLRSLGNPSFLPRCLNYKIGAKRKRKSRSTGMVVFNYKDCNNTLQRTEVREDCSCPFCSMLCGSFKGLQFHLNSSHDLFEFEFKLLEEYQTVNVSVKLNSFIFEEEGSDDDKFEPFSLCSKPRKRRQRGGRNNTRRLKVCFLPLDSPSLANGTENGIALLNDGNRGLGYPEATELAGQFEMTSNIPPAIAHSSLDAGAKVILTTEAVVPATKTRKLSAERSEARSHLLLQKRQFYHSHRVQPMALEQVMSDRDSEDEVDDDVADFEDRQMLDDFVDVNKDEKQFMHLWNSFVRKQRVIADGHISWACEVFSRFYEKELHCYSSLFWCWRLFLIKLWNHGLVDSATINNCNTILENCRNTSVTNNNNNSVDHPSDSNTNNNNIVDHPNDIKNKNNVDNKDNNSRDK

SEQ ID NO: 999 - DNA, 684 bp, Arabidopsis thaliana
  G3111,family:RING/C3H2C3
caacaacaaaacctcttactcactccaatggctcgccttctctttcgtcttctcgtagaatccaacactccgtctccggcgattgataactccaccgccgcgttgaattctgatctcgtcgtcatcctcgctgctctcctctgcgccttgatttgcgttctcggcttaatcgccgtttctcgatgtgtctggctccgtcgtctcgcagccggaaacagaacagtctccggatctcaaactcaatctcctcaacctccggtggcagcggcgaacaaaggcctgaagaagaaagtccttcaatctctcccgaagcttacgttctcgccagagtcacctgagtcggagaaattcgcagagtgcgcgatctgtctagctgaattctctgccggcgacgagctccgagttttaccgcagtgtggtcacgggttccacgtggcttgcattgacacgtggctaggatctcactcgtcttgcccttcttgccgtcagatcttggttgttgccaggtgtcacaagtgtggaggtttacccggtagctctagctccggacttgaatccgaacccgaaatcgagatccgaatcaagcaaggcgaagatgaccccaactccttcttgccataatcattttagtttcccatttatttattagaaaactctataatttaatgcagatcattttagtgg

SEQ ID NO: 1000 - protein, 197 aa, Arabidopsis thaliana
  G3111,RING/C3H2C3 domain coordinates 111-152
MARLLFRLLVESNTPSPAIDNSTAALNSDLVVILAALLCALICVLGLIAVSRCVWLRRLAAGNRTVSGSQTQSPQPPVAAANKGLKKKVLQSLPKLTFSPESPESEKFAECAICLAEFSAGDELRVLPQCGHGFHVACIDTWLGSHSSCPSCRQILVVARCHKCGGLPGSSSSGLESEPEIEIRIKQGEDDPNSFLP

SEQ ID NO: 1001 - DNA, 911 bp, Arabidopsis thaliana
  G32,family:AP2
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 1002 - protein, 211 aa, Arabidopsis thaliana
  G32,AP2 domain coordinates 17-84
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 1003 - DNA, 756 bp, Arabidopsis thaliana
  G321,family:RING/C3HC4
atgtattatcagttgaccaagtcttcttacagagactctttgaagattctggaggctgatattgagcacgccaatggactggctgctgagattccaatgggaaagagcggtgtgcgacttcagatgaaattggtgtgcagcaatttggctccattcttcatattcctgctacaatggatggatttctcatgtctgcttccaagatattttgatttcttccacatactcatatacaaggtacgtgctgatgggcggtggaatcgatctaggtacggaaggaaagctacgattagggagttttacggtgttatattaccatcacttgagcgacttcatatcaactttgctgacttaccggacgaaagcttgtggtatccgaatccaaaagccatcaccaagaagcagtatgacattgaaggtagcagatacatgaatagcattgacttggaaagagaagacgaatgcgggatttgcttagagccttgcaccaaaatggtgttgccaaactgttgtcatgccatgtgcatcaaatgttaccgtaactggaacacaaagtcggagtcatgcccgttttgtcgtggcagcatcaagagagtgaactcagaggatctgtgggtgctaacttgcgatgaagatgtggtggatccagagacggtcaccaaagaggatcttcttcggttctacctccacatcaatagccttcctaaggattatccagaagcggccttcttagtctacaacgagtacttgatatga

SEQ ID NO: 1004 - protein, 251 aa, Arabidopsis thaliana
  G321,RING/C3HC4 domain coordinates NA
MYYQLTKSSYRDSLKILEADIEHANGLAAEIPMGKSGVRLQMKLVCSNLAPFFIFLLQWMDFSCLLPRYFDFFHILIYKVRADGRWNRSRYGRKATIREFYGVILPSLERLHINFADLPDESLWYPNPKAITKKQYDIEGSRYMNSIDLEREDECGICLEPCTKMVLPNCCHAMCIKCYRNWNTKSESCPFCRGSIKRVNSEDLWVLTCDEDVVDPETVTKEDLLRFYLHINSLPKDYPEAAFLVYNEYLI

SEQ ID NO: 1005 - DNA, 684 bp, Arabidopsis thaliana
  G322,family:RING/C3HC4
atggtgaatggagaatcatcaactagtacgtcttactctgatagtaacaatgacacaaatgatcaaggaggagactttgaatgtaacatttgtttcgaactagctcaagatccgattgtcactctctgtggccatctcttttgctggccttgcttataccgttggcttcaccaccattcacattctcaagaatgtccggtttgtaaagccgtggttcaagacgataagcttgttcctctttacggtagaggcaagaaccagactgacccgagatcaaaacgttatccgggtttacggattcctaaccgaccaacaggtcaaagacctgagactgctgctcctcctcctcagcctgaagctgcgagtaattttttcaactacggtattggtttgatgggtggaattatgccgatgatggcgactacgaggtttgggaatttcagtatggggtttggtggtttgttaccttctttgtttaactttcagtttcatggatttcatgatgctacgctttatggttcaacaccgggttatccttacggtggttatcataacggtttccgtggagttcctcctcgtggacaagagcgtcctatggctcgtggaggaaaccaaagtgatgcatttctgaagaatatcctcttttttgttggaatctgtgtggtgatatttctcatctggtga

SEQ ID NO: 1006 - protein, 227 aa, Arabidopsis thaliana
  G322,RING/C3HC4 domain coordinates NA
MVNGESSTSTSYSDSNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 1007 - DNA, 871 bp, Arabidopsis thaliana
  G323,family:RING/C3HC4
ctgctcatatcagccattgacacagttgctttgggtttccctcaaacggcgccgattgtctggattttgaccactgatggccttagatcaatcttttgaagatgctgctttacttggagaactctatggagaaggtgcattttgtttcaagagcaagaaacctgaacccattacagtctcggttccttctgatgatactgatgattcgaattttgactgcaatatttgcttagactcggtgcaagaacctgttgtgactctctgtggtcacctcttttgctggccttgtattcacaaatggcttgatgtacagagcttctcaacaagtgatgaataccaaagacatagacagtgtcctgtttgtaaatctaaagtttctcattctactttggttcctttgtatggtagaggccgttgtactactcaggaggaaggtaaaaacagtgtgcctaaaagacccgtaggaccggtttatcggcttgaaatgccgaattcaccttatgcaagtactgatctgcggttatcacaacgggttcatttcaatagcccacaggaaggttactaccctgtctcaggggtgatgagctcgaacagtttatcatactctgctgttttggatccggtgatggtgatggttggagaaatggtagctacgaggttgtttggaacacgagtgatggatagatttgcgtatccggacacttacaatctcgcagggactagcgggccgaggatgagaaggcggataatgcaggcagataaatcgctgggaagaatcttcttcttctttatgtgttgtgttgttctgtgtcttctcttgttttaggttttcatagctagcttggttctgctactgttcagtttcttcagg

SEQ ID NO: 1008 - protein, 249 aa, Arabidopsis thaliana
  G323,RING/C3HC4 domain coordinates 48-96
MALDQSFEDAALLGELYGEGAFCFKSKKPEPITVSVPSDDTDDSNFDCNICLDSVQEPVVTLCGHLFCWPCIHKWLDVQSFSTSDEYQRHRQCPVCKSKVSHSTLVPLYGRGRCTTQEEGKNSVPKRPVGPVYRLEMPNSPYASTDLRLSQRVHFNSPQEGYYPVSGVMSSNSLSYSAVLDPVMVMVGEMVATRLFGTRVMDRFAYPDTYNLAGTSGPRMRRRIMQADKSLGRIFFFFMCCVVLCLLLF

SEQ ID NO: 1009 - DNA, 1558 bp, Arabidopsis thaliana
  G326,family:Z-CO-like
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaaaaaaaaaa

SEQ ID NO: 1010 - protein, 401 aa, Arabidopsis thaliana
  G326,Z-CO-like domain coordinates 11-94,354-400
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 1011 - DNA, 1068 bp, Arabidopsis thaliana
  G328,family:Z-CO-like
atgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctga

SEQ ID NO: 1012 - protein, 355 aa, Arabidopsis thaliana
  G328,Z-CO-like domain coordinates 12-78
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 1013 - DNA, 1169 bp, Arabidopsis thaliana
  G335,family:Z-Tall-1
ttagctcaatatgtcggatgagttgtggaatgagatacaaaacctagaattaggtcaagaagatccagccctttttatccctcatgaggcttatgtgatggtggaagctaccaatagacttagtatgatagctagacctctgaacccaagggtccagaacctcaattctgttgtggtagcattaccaagaacatggggtttaacaaatcaagttcatggcagaatacttgatgctacttatgttcagtttctttttcaaaatgaaattgatctaatgatggttcaacgcaaggagccttggctttttaacaattggtttgttgcagctactcgatgggaggtggcaccggctcataacttcgttactacaattgatctgtgggtgcagattcgtggaatccctctgccatatgtttctgaggagacggttatggagattgctcaagatctgggggaagttcttatgctagactaccatgatacaacatctattcagattgcttacatacgggtgagagtgcgctttggtattacggacaggctaaggttctttcagcgaattgtctttgactccggggaaactgcaacaataagatttcagtatgaacgtctccggagaatctgcagtagctgcttcagattcactcacaacagagcttattgtccataccgaccaagacctctcagcattgcaagggaaagagctctgtttagggatagtgtgcatcgttcctccatgaactctcagtctcagatgactgatagttcatttccaattccccagactccaccaccaagaatatcccacccaccactgaatcatgatgagtttgtagctgcttatcctcacttggactcaggtaggaatgaccacatcagatgtgagggagaatcaagcaatttcagacaagacttgtcttcagcttcaaactccataactccaagaagggaaccacaatacctaactgatagaagacactttgaacctggtcaatcctcaagaagacatgatgttcgggatttaagaagagggtcagagaggattgggaatctcaatcaacagaactatgtgcaaagatcaggagggatactgaaacctccgaagaaacgctaaacactctaccaacttctgttttttttggattgaagtctgcaggttaacaaggaag

SEQ ID NO: 1014 - protein, 367 aa, Arabidopsis thaliana
  G335,Z-Tall-1 domain coordinates 205-218
MSDELWNEIQNLELGQEDPALFIPHEAYVMVEATNRLSMIARPLNPRVQNLNSVVVALPRTWGLTNQVHGRILDATYVQFLFQNEIDLMMVQRKEPWLFNNWFVAATRWEVAPAHNFVTTIDLWVQIRGIPLPYVSEETVMEIAQDLGEVLMLDYHDTTSIQIAYIRVRVRFGITDRLRFFQRIVFDSGETATIRFQYERLRRICSSCFRFTHNRAYCPYRPRPLSIARERALFRDSVHRSSMNSQSQMTDSSFPIPQTPPPRISHPPLNHDEFVAAYPHLDSGRNDHIRCEGESSNFRQDLSSASNSITPRREPQYLTDRRHFEPGQSSRRHDVRDLRRGSERIGNLNQQNYVQRSGGILKPPKKR

SEQ ID NO: 1015 - DNA, 2183 bp, Arabidopsis thaliana
  G341,family:Z-C3H
gaatccgattccacaggtggaactatgtgctgtggatcagaccgattaaaccagatcgtgtcatcaagatcttcgttgccaatttctttcgaggaagataacaatcttgttaccaacacagacatgaatcacttaacagtcgaaacagaggatacgtttgcgagcttgcttgagcttgcagctaacaacgatgttgaaggtgtaaggctatctatcgagagagacccttcttgtgtagacgaagctggtctctggtacggtcgtcaaaaaggttctaaagctatggtcaacgattacaggactccgttgatggttgctgctacttacggaagcattgatgtgatcaagcttattgtttctttgactgatgctgacgtgaaccgtgcttgcgggaatgatcagaccactgcgttacactgcgctgcttctggaggagctgtgaatgctatccaagttgttaagctgcttcttgcagctggagctgatttgaatctgttggatgctgaaggtcaacgagctggtgatgttattgttgttcctcctaagcttgaaggcgtgaagctgatgcttcaggagcttctttctgctgatggatcatctactgcggagcggaatctacgggttgtgacaaatgttccgaatagaagctcatctccgtgtcattctcctactggagagaatggtggatcagggtctggttcaccgctcggctctccttttaagctgaaatctactgaattcaagaaagagtatccggttgatccgtctttgccagatatcaagaacagtatctacgcgactgatgagtttagaatgtattccttcaaggtccggccttgctctcgtgcttattcacatgattggactgagtgtccttttgttcacccgggtgaaaacgcgaggaggagagacccgaggaagttccattacagctgcgttccttgcccggattttaggaaaggagcttgtaggagaggagatatgtgtgagtatgcgcacggtgtgtttgaatgctggcttcatccggctcagtacaggacccgtctttgcaaagatggaacaggctgtgctcggcgggtttgtttctttgcgcatacacccgaggagcttcgacctttgtacgcatcaactggttcagcggttccttcgcctagatcgaatgctgattatgcagctgctttgagtctccttcctggttctccatcaggagtctctgtcatgtccccgctttccccatcagcagcggggaacggaatgtctcattcgaatatggcttggccacaaccaaatgtccctgcgttgcacttaccaggaagcaatctacagtcaagcaggctaaggtcttctctcaatgcaagggatatcccgacggatgagttcaatatgttagcggattacgagcagcagcaactcctcaacgagtattccaatgctctgagccgttctggtcggatgaaatcaatgcctccttcgaatcttgaagatcttttctcagcagaaggctcttcatctccccggttcactgattccgctttagcttccgcggtgttctcgcctacacacaagtcagctgtcttcaaccagttccaacaacagcaacagcagcagcagagcatgttgtctccaatcaacacaagcttttcttcaccaaagagcgttgaccactcattgttttcaggtggaggaagaatgtctcctcggaatgttgttgaaccaatatcacccatgagtgctcgggtttccatgttggctcagtgcgtgaagcaacaacaacagcaacagcagcagcagcagcagcaacatcagttccgtagccttagctccagagagctcagaacaaactctagcccaatcgttggttcaccggtaaacaacaacacatggtcatcaaaatggggatcttcaaatggtcaaccggattggggaatgagctcagaagcacttggtaagttgagatcttcgtcatcgtttgatggtgatgagcctgatgtgtcatgggtccagtcactggtgaaggagactccagcagaagccaaagagaaagcagcaacatcttcctcaggggaacacgtgatgaagcagccaaatccggttgaaccggtaatggatcatgctgggctagaagcttggattgagcaaatgcagctcgatcagcttgtggctcagcagaattgagagaccta

SEQ ID NO: 1016 - protein, 716 aa, Arabidopsis thaliana
  G341,Z-C3H domain coordinates 254-374
MCCGSDRLNQIVSSRSSLPISFEEDNNLVTNTDMNHLTVETEDTFASLLELAANNDVEGVRLSIERDPSCVDEAGLWYGRQKGSKAMVNDYRTPLMVAATYGSIDVIKLIVSLTDADVNRACGNDQTTALHCAASGGAVNAIQVVKLLLAAGADLNLLDAEGQRAGDVIVVPPKLEGVKLMLQELLSADGSSTAERNLRVVTNVPNRSSSPCHSPTGENGGSGSGSPLGSPFKLKSTEFKKEYPVDPSLPDIKNSIYATDEFRMYSFKVRPCSRAYSHDWTECPFVHPGENARRRDPRKFHYSCVPCPDFRKGACRRGDMCEYAHGVFECWLHPAQYRTRLCKDGTGCARRVCFFAHTPEELRPLYASTGSAVPSPRSNADYAAALSLLPGSPSGVSVMSPLSPSAAGNGMSHSNMAWPQPNVPALHLPGSNLQSSRLRSSLNARDIPTDEFNMLADYEQQQLLNEYSNALSRSGRMKSMPPSNLEDLFSAEGSSSPRFTDSALASAVFSPTHKSAVFNQFQQQQQQQQSMLSPINTSFSSPKSVDHSLFSGGGRMSPRNVVEPISPMSARVSMLAQCVKQQQQQQQQQQQQHQFRSLSSRELRTNSSPIVGSPVNNNTWSSKWGSSNGQPDWGMSSEALGKLRSSSSFDGDEPDVSWVQSLVKETPAEAKEKAATSSSGEHVMKQPNPVEPVMDHAGLEAWIEQMQLDQLVAQQN

SEQ ID NO: 1017 - DNA, 717 bp, Arabidopsis thaliana
  G344,family:GATA/Zn
atggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaa

SEQ ID NO: 1018 - protein, 238 aa, Arabidopsis thaliana
  G344,GATA/Zn domain coordinates 166-192
MECVEAFLGDFSVDDLLDLSNADTSLESSSSQRKEDEQEREKFKSFSDQSTRLSPPEDLLSFPGDAPVGDLEDLEWLSNFVEDSFSESYISSDFPVNPVASVEVRRQCVPVKPRSKRRRTNGRIWSMESPSPLLSTAVARRKKRGRQKVDASYGGVVQQQQLRRCCSHCGVQKTPQWRMGPLGAKTLCNACGVRFKSGRLLPEYRPACSPTFTNEIHSNSHRKVLELRLMKVADPARV

SEQ ID NO: 1019 - DNA, 917 bp, Arabidopsis thaliana
  G345,family:GATA/Zn
gtatgtgttaaagagtgaatggagctgtggacagaagctagagccttaaaggcaagtctaagaggagaatctactatatctctcaaacatcaccaagtgattgtgtcggaagatttaagccgaacttcttccttgccggaagatttctccgttgagtgtttcctcgatttctcagaaggtcaaaaagaagaagaagaagaagttgtctctgtttcttcttcacaagagcaagaagaacaagaacatgattgtgtctttagttcacaaccttgcatctttgatcaacttccttctttgccggatgaagatgtggaagagcttgaatgggtatctcgtgttgtggatgattgttcatcaccagaagtttcacttctcttaacacaaacacataaaaccaaaccaagcttctcaagaattccggttaaaccaagaaccaaacggtctcggaacagtttaaccggtagtcgtgtttggccactcgtttcaaccaatcatcaacatgcagcaacagagcagttgaggaagaagaaacaagaaactgtccttgtgtttcaacgaagatgcagccattgtggcacaaacaacacaccacagtggagaaccggtccggtcggtccaaaaaccttatgtaatgcatgtggagtccggtttaagtctggtaggctctgcccggaatacagaccggcggatagtccgacgttctcgaatgagattcactcaaatcttcataggaaggttctggaattaagaaagagtaaagagttgggtgaagaaacaggtgaagctagtactaaatcagacccagtcaaatttggcagcaagtggtagataagacttaggtaaaacctactttttgtaacattatctgtagtgttgtaatttaacaacttgcttcttaacaaaaaaaaaaaaaaaaa

SEQ ID NO: 1020 - protein, 269 aa, Arabidopsis thaliana
  G345,GATA/Zn domain coordinates NA
MELWTEARALKASLRGESTISLKHHQVIVSEDLSRTSSLPEDFSVECFLDFSEGQKEEEEEVVSVSSSQEQEEQEHDCVFSSQPCIFDQLPSLPDEDVEELEWVSRVVDDCSSPEVSLLLTQTHKTKPSFSRIPVKPRTKRSRNSLTGSRVWPLVSTNHQHAATEQLRKKKQETVLVFQRRCSHCGTNNTPQWRTGPVGPKTLCNACGVRFKSGRLCPEYRPADSPTFSNEIHSNLHRKVLELRKSKELGEETGEASTKSDPVKFGSKW

SEQ ID NO: 1021 - DNA, 800 bp, Arabidopsis thaliana
  G35,family:AP2
ggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatcaaaaaaaaaaaaaaaaa

SEQ ID NO: 1022 - protein, 159 aa, Arabidopsis thaliana
  G35,AP2 domain coordinates NA
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 1023 - DNA, 1099 bp, Arabidopsis thaliana
  G350,family:Z-C2H2
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 1024 - protein, 238 aa, Arabidopsis thaliana
  G350,Z-C2H2 domain coordinates 91-113,150-170
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 1025 - DNA, 775 bp, Arabidopsis thaliana
  G351,family:Z-C2H2
ctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacg

SEQ ID NO: 1026 - protein, 193 aa, Arabidopsis thaliana
  G351,Z-C2H2 domain coordinates 77-97,118-140
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 1027 - DNA, 817 bp, Arabidopsis thaliana
  G352,family:Z-C2H2
aatacaccacacacttcactctttcttcatcttcttcttcttaaatagctcgaaatcacatctcacagaattaaatcttatggctctcgagactctcaattctccaacagctaccaccaccgctcggcctcttctccggtatcgtgaagaaatggagcctgagaatctcgagcaatgggctaaaagaaaacgaacaaaacgtcaacgttttgatcacggtcatcagaatcaagaaacgaacaagaaccttccttctgaagaagagtatctcgctctttgtctcctcatgctcgctcgtggctccgccgtacaatctcctcctcttcctcctctaccgtcacgtgcgtcaccgtccgatcaccgagattacaagtgtacggtctgtgggaagtccttttcgtcataccaagccttaggtggacacaagacgagtcaccggaaaccgacgaacactagtatcacttccggtaaccaagaactgtctaataacagtcacagtaacagcggttccgttgttattaacgttaccgtgaacactggtaacggtgttagtcaaagcggaaagattcacacttgctcaatctgtttcaagtcgtttgcgtctggtcaagccttaggtggacacaaacggtgtcactatgacggtggcaacaacggtaacggtaacggaagtagcagcaacagcgtagaactcgtcgctggtagtgacgtcagcgatgttgataatgagagatggtccgaagaaagtgcgatcggtggccaccgtggatttgacctaaacttaccggctgatcaagtctcagtgacgacttcttaa

SEQ ID NO: 1028 - protein, 245 aa, Arabidopsis thaliana
  G352,Z-C2H2 domain coordinates 99-119,166-186
MALETLNSPTATTTARPLLRYREEMEPENLEQWAKRKRTKRQRFDHGHQNQETNKNLPSEEEYLALCLLMLARGSAVQSPPLPPLPSRASPSDHRDYKCTVCGKSFSSYQALGGHKTSHRKPTNTSITSGNQELSNNSHSNSGSVVINVTVNTGNGVSQSGKIHTCSICFKSFASGQALGGHKRCHYDGGNNGNGNGSSSNSVELVAGSDVSDVDNERWSEESAIGGHRGFDLNLPADQVSVTTS

SEQ ID NO: 1029 - DNA, 628 bp, Arabidopsis thaliana
  G354,family:Z-C2H2
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 1030 - protein, 168 aa, Arabidopsis thaliana
  G354,Z-C2H2 domain coordinates 42-62,88-109
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 1031 - DNA, 615 bp, Arabidopsis thaliana
  G357,family:Z-C2H2
atgcagaacaaacacaaatgcaagctctgttccaagagtttctgtaatggcagagcacttggtggtcacatgaagtctcacttggtctcatctcagtcttcagctcggaagaaactaggtgactcggtctattcttcttcttcctcttcctccgatggtaaagcgctcgcctacgggttacgagagaacccgaggaagagtttccgggtctttaatccggatcctgagtcatccacaatttacaacagtgagacagagaccgaacctgaatccggagacccggttaagaaacgggtcagaggagatgtttcaaagaagaagaagaagaaggcaaagagtaagagagtgtttgagaactcgaagaagcaaaagacaattcacgagtcaccagaaccagcgagttctgtctctgatggttctcctgaacaagatttagctatgtgcttgatgatgctgtcaagagattcaagggagctcgagattaaactgaaaaaaccggaggaagagaggaagccggaaaaaagacatttccctgagctccgtcgctgtatgatagatctgaatcttcctccgccgcaagaagctgaagctgtcaccgtcgtttcagccatataa

SEQ ID NO: 1032 - protein, 204 aa, Arabidopsis thaliana
  G357,Z-C2H2 domain coordinates 7-29
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 1033 - DNA, 1251 bp, Arabidopsis thaliana
  misc_feature (973)..(973): n is a, c, g, or t
  G36,family:AP2
cccacgcgtccgaaaaaatgctataattcttcctttttcttgttctttcagagattttgatttctattcaatcgactaagagggtgtgtttttaatccctctctgttttaattttgtttcctagtctttaaagatccatggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatcttaaacaaagcaaagagaagnctttttcttttaggagtttgtctttcaatttcagtgtcttatattaatctctctgcaactgaaatttttaacagttgcggagagaatcgtctctagggtttgtttctcttcctccatgttttggtctgactggtttatgtcttttttttttttttgaactttcaaaaacctttgtcattgaccaatcggagaagtttccatgtattctctcatctttaaatttctaatgaagaatgtaaattattagtcttttgctaaaaaaaaaaaaaaaaaaaaaa

SEQ ID NO: 1034 - protein, 272 aa, Arabidopsis thaliana
  G36,AP2 domain coordinates NA
MAAIDMFNSNTDPFQEELMKALQPYTTNTDSSSPTYSNTVFGFNQTTSLGLNQLTPYQIHQIQNQLNQRRNIISPNLAPKPVPMKNMTAQKLYRGVRQRHWGKWVAEIRLPKNRTRLWLGTFDTAEEAAMAYDLAAYKLRGEFARLNFPQFRHEDGYYGGGSCFNPLHSSVDAKLQEICQSLRKTEDIDLPCSETELFPPKTEYQESEYGFLRSDENSFSDESHVESSSPESGITTFLDFSDSGFDEIGSFGLEKFPSVEIDWDAISKLSES

SEQ ID NO: 1035 - DNA, 977 bp, Arabidopsis thaliana
  G362,family:Z-C2H2
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 1036 - protein, 211 aa, Arabidopsis thaliana
  G362,Z-C2H2 domain coordinates 62-82
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 1037 - DNA, 780 bp, Arabidopsis thaliana
  G363,family:Z-C2H2
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 1038 - protein, 259 aa, Arabidopsis thaliana
  G363,Z-C2H2 domain coordinates 87-108
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 1039 - DNA, 925 bp, Arabidopsis thaliana
  G365,family:Z-C2H2
caattcttttactttcattctctttatatattctctctacgctataatatatattacacagaatatacatggaaccgtccatcaaaggagatcaagaaatgttaaaaatcaagaaacaaggtcatcaagatcttgagttggggttgacccttttgtcacgtggaaccgcgacctcatcagagctcaatctcatcgattctttcaaaaccagctcatcatcgacttctcatcatcagcaccagcaagaacaattggcagatccgagagtgttctcgtgtaattattgtcaaagaaagttctatagttcacaagcgctaggcggtcaccaaaacgctcataaacgtgagcgcaccttagccaaacgtggacagtattacaagatgactctctcctccttgccttcttcagcgtttgcgtttggccacggttcagtcagcagattcgcaagcatggcatcgttaccattacatggctcggtgaataacaggtcaacgttagggattcaagctcattcaacgatccataagcccagcttcttaggaagacaaacgacgagtttaagtcatgttttcaaacagagcattcaccagaaaccgaccataggaaagatgttgccggagaaatttcaccttgaagtcgccggaaataataacagtaacatggttgctgctaagttggagagaattggacatttcaagagcaaccaagaagatcataatcagtttaagaaaattgacttgactcttaagctatgagctctgccatcttctttttagtcttcattataactttttttattctcatctttgtttgatataatgattgacggcagggtgtgttagagtttcactaatgatcaagttgtactttttatatatttcattgataccttgttgatgtaattcaatattttaggtctgttttt

SEQ ID NO: 1040 - protein, 228 aa, Arabidopsis thaliana
  G365,Z-C2H2 domain coordinates 70-90
MEPSIKGDQEMLKIKKQGHQDLELGLTLLSRGTATSSELNLIDSFKTSSSSTSHHQHQQEQLADPRVFSCNYCQRKFYSSQALGGHQNAHKRERTLAKRGQYYKMTLSSLPSSAFAFGHGSVSRFASMASLPLHGSVNNRSTLGIQAHSTIHKPSFLGRQTTSLSHVFKQSIHQKPTIGKMLPEKFHLEVAGNNNSNMVAAKLERIGHFKSNQEDHNQFKKIDLTLKL

SEQ ID NO: 1041 - DNA, 1032 bp, Arabidopsis thaliana
  G368,family:Z-C2H2
gttgcgtttccacatttgtttaaacataactctctctctctctctctctctctctctctctcagtacctcttattcttatgctcttcttcaccaatcctatctcttctatctgtctttattttctctacatgtgaattgacccatttctggtaaacacatagagtaccacttttcttatttagattcttcttcctcttcatagcttccaagtcaactacttcagcttctgtcggctgtctcttcccagatctcgttaagaccaaaacttggaataaatgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaaaaggattaaggagattatatctttattgttatttttctattgttagacattcagaagataagttggagacagttgatagaaattgatgaaaaactttgttgttatattaaatgaggttgttcatta

SEQ ID NO: 1042 - protein, 209 aa, Arabidopsis thaliana
  G368,Z-C2H2 domain coordinates NA
MTESDDASRETPASRGGEASSNQDLSKPESNHVSLDLKLNDTFNDDTKSTKCEANPRVFSCNYCRRKFYSSQALGGHQNAHKRERTMAKRAMHMGRMFGHHHRPYTYTSSSLGMQAHSGLLHHTLSQPQPLVSRFHHQGYFGNTVPLFFDYDDGGSDFFWPGSFRQVVEEAEAPVVVVASTESGLDLNSVAANGGVDNNSSKPDLTLRL

SEQ ID NO: 1043 - DNA, 1336 bp, Arabidopsis thaliana
  G379,family:RING/C3HC4
tggaaggagacatggtggctaaagtgaagagagaaacggtggtggcatgcatgacttgtcctctctgtgacaaactcctccgtgacgccactaccatttcagagtgtcttcacacgttttgtaggaaatgcatttatgagaaaatcacagaggatgagatagagagctgtccagtatgcgatattgacctcgggggtaccccactggagaaactaaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccagggtttcagcacaagctggtacaacaggaaaaagaacaaaagctgctacgagaaaagatgtaagaggtagtggttcattcactaagagaacagtgaagaaggaagaagaatttggagatgatcatgtagagagcgcaagctcgcctgaaacacttaaaaagtttactcagaataaaagacagtcttcatatgcaaatcctaaccagtccctctctaatcgaagaaacaaggatgttgatgaaccatgggattccaaattacatctttggaaacctctaaattttcttgtggatgtggcaaacggaacaaaggacccaaaatctgagcttggaaacgcatcccacaatgatgttcaggggagtaaaaccaaaacaaaggatcataaaagaaagtgtaaactcgaggaagagatcagcaataacggtgatcctacaacatcagaaactgctacacttaaacgaacgcgtcggactcgtcgcaaaaggtcatctacttttggtgattctagaattccactgttaccaggtgcagcaagcctaaaacaggagaggagaaacggtcatgtttggttctcacttgtagcgtcaagtaatcaggaaggagaagcatcattgcctcagattccagcaaactacttgagaataagggatggaaatattccagtttcttttatccaaaagtacctcatgaggaagcttgatctcaagagtgaagatgaggtagagataacatgtatgggagaaccagtgatcccaacgttgcagcttcacagcttagtagacctatggttggaaacaacttctaagcatcaaagagtcgctgcgtcaataggttcatctgcaaaggaatttgtaatggtgctagtttattctcggaagctccctgaatgcaacaactaaagagctattcattgaatcttttctagaccgagaagaaagaaaagtgcaggagcagtggaatgtcttgtgtagaa

SEQ ID NO: 1044 - protein, 416 aa, Arabidopsis thaliana
  G379,RING/C3HC4 domain coordinates 16-56
MVAKVKRETVVACMTCPLCDKLLRDATTISECLHTFCRKCIYEKITEDEIESCPVCDIDLGGTPLEKLRPDHILQDLRAKLFPLKRKKERAPEVVSSISLPAKRKERSISSLVVSTPRVSAQAGTTGKRTKAATRKDVRGSGSFTKRTVKKEEEFGDDHVESASSPETLKKFTQNKRQSSYANPNQSLSNRRNKDVDEPWDSKLHLWKPLNFLVDVANGTKDPKSELGNASHNDVQGSKTKTKDHKRKCKLEEEISNNGDPTTSETATLKRTRRTRRKRSSTFGDSRIPLLPGAASLKQERRNGHVWFSLVASSNQEGEASLPQIPANYLRIRDGNIPVSFIQKYLMRKLDLKSEDEVEITCMGEPVIPTLQLHSLVDLWLETTSKHQRVAASIGSSAKEFVMVLVYSRKLPECNN

SEQ ID NO: 1045 - DNA, 636 bp, Arabidopsis thaliana
  G383,family:GATA/Zn
atgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtga

SEQ ID NO: 1046 - protein, 211 aa, Arabidopsis thaliana
  G383,GATA/Zn domain coordinates 77-102
MGFSMFFSPENDVSHHSSPYASVDCTLSLGTPSTRLCNEDDERRFSSHTSDTIGWDFLNGSKKGGGGGGHNLLARRCANCDTTSTPLWRNGPRGPKSLCNACGIRFKKEERRASTARNSTSGGGSTAAGVPTLDHQASANYYYNNNNQYASSSPWHHQHNTQRVPYYSPANNEYSYVDDVRVVDHDVTTDPFLSWRLNVADRTGLVHDFTM

SEQ ID NO: 1047 - DNA, 2217 bp, Arabidopsis thaliana
  G385,family:HB
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 1048 - protein, 721 aa, Arabidopsis thaliana
  G385,HB domain coordinates 60-123
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 1049 - DNA, 2502 bp, Arabidopsis thaliana
  G392,family:HB
atgggaggaggaagcaataatagtcacaatatggacaacgggaagtacgtgaggtacactcctgaacaagtggaagctctggagagactctacaatgactgtcctaaaccgagctctatgcgccgccaacagctaatccgcgaatgtcctatcctctccaacatcgagcctaaacagataaaagtctggttccagaaccgcaggtgtagagaaaaacagcgaaaagaggcgtcacgacttcaagctgtgaataggaagctaacggcaatgaacaagcttttgatggaagagaatgaccgcttgcaaaagcaagtgtctcacttggtttatgagaacagctattttcgccaacatcctcaaaaccaggggaatttggctaccacagatactagctgtgagtcagtggtgacgagtggtcaacaccacttgacccctcaacatcagcctcgtgatgctagtcctgctggattattgtccattgcggatgaaactttaacagagttcatttccaaggcgactggaaccgctgtcgagtgggtccaaatgcctgggatgaagcctggtccggattccataggaatcgttgctatttctcatggatgcacgggaatcgctgctcgtgcttgcggccttgtgggtcttgatcccacaagggtcgcggagatcctaaaggataagccttgttggttgcgtgattgcagatctctggatatagttaacgtactatccactgcaaatggtggaacccttgaactaatctacatgcagctttatgcgccgacaacactggcaccagctcgtgacttctggatgctacgttacacatctgtaatggaagacgggagccttgtgatatgcgaacgatcactgaacaatacacaaaacgggccaagtatgcctccgtctcctcatttcgttagggcagagattttaccaagtggttacctcattagaccttgcgaaggaggtggatccattcttcacattgtcgatcatttcgatcttgagccatggagtgtgccagaagttcttcgttctctctatgagtcctccactttactcgcccaaagaactacaatggccgctctgcgctatttgaggcaaatatctcaagagatttcacaacctaacgtaacaggttggggaagaagaccagcggctcttagagcacttagccaaaggcttagcaaaggattcaacgaagcagtgaatgggttcagcgatgaaggatggtccatcctagagagtgatggtatcgatgatgtcactcttcttgtgaactcctctcccacaaagatgatgatgacttcaagtctcccatttgccaatggctacacttctatgcctagcgcggtcttatgtgccaaagcttccatgttattacaaaatgttccaccttcgattctgctgcggttcttgagggaacatagacaagaatgggcagacaatagcatcgatgcatattcggccgcagccatcaaagcaggcccttgtagcttaccaatccctcgcccagggagctttggtggtcaagtcattcttcctctagctcacactatagagaatgaagagtttatggaagtcattaagcttgagagcttggggcactaccaagaagacatgatgatgcctgctgatatcttccttctgcaaatgtgcagtggggtggatgagaacgcagttgaatcatgcgcagagcttatatttgcaccaatcgacgcatctttctctgatgatgcaccaatcattccttccggtttccgcatcattcctctagattccaaatcagaggggttgagtcctaaccgaacgctagacctagcgtcggctctagacgtagggagcagaacagccggagattcatgtggaagcagaggaaactcaaagtccgttatgactatagcgtttcagctagcttttgagatgcatatgcaagagaatgtagcctcaatggctagacagtatgtaagaagtgtgatcgcgtcggttcaacgggtcgcacttgctctctctccttcttctcatcagctaagtggcttgcgtcctccacccgcgtcacccgaagctcacactctcgctcgctggatctctcactcttatagatgttaccttggcgttgatcttctcaaacctcatggaactgatcttctcaagtctctttggcaccatcctgacgctgtcatgtgttgctcactcaaggccttatctccggtattcacatttgcgaaccaagctggtttagacatgctggagacgacgttggtggcacttcaagatatcactctcgacaagatcttcgacaacaacaacgggaagaagactttatcctccgaattccctcagatcatgcaacaggggtttatgtgtatggatggaggaatatgcatgtcgagcatgggaagagcagtaacgtacgagaaggctgttgggtggaaagtgttgaacgacgacgaagatcctcattgtatctgcttcatgttcctcaactggtcttttatatga

SEQ ID NO: 1050 - protein, 833 aa, Arabidopsis thaliana
  G392,HB domain coordinates 15-75
MGGGSNNSHNMDNGKYVRYTPEQVEALERLYNDCPKPSSMRRQQLIRECPILSNIEPKQIKVWFQNRRCREKQRKEASRLQAVNRKLTAMNKLLMEENDRLQKQVSHLVYENSYFRQHPQNQGNLATTDTSCESVVTSGQHHLTPQHQPRDASPAGLLSIADETLTEFISKATGTAVEWVQMPGMKPGPDSIGIVAISHGCTGIAARACGLVGLDPTRVAEILKDKPCWLRDCRSLDIVNVLSTANGGTLELIYMQLYAPTTLAPARDFWMLRYTSVMEDGSLVICERSLNNTQNGPSMPPSPHFVRAEILPSGYLIRPCEGGGSILHIVDHFDLEPWSVPEVLRSLYESSTLLAQRTTMAALRYLRQISQEISQPNVTGWGRRPAALRALSQRLSKGFNEAVNGFSDEGWSILESDGIDDVTLLVNSSPTKMMMTSSLPFANGYTSMPSAVLCAKASMLLQNVPPSILLRFLREHRQEWADNSIDAYSAAAIKAGPCSLPIPRPGSFGGQVILPLAHTIENEEFMEVIKLESLGHYQEDMMMPADIFLLQMCSGVDENAVESCAELIFAPIDASFSDDAPIIPSGFRIIPLDSKSEGLSPNRTLDLASALDVGSRTAGDSCGSRGNSKSVMTIAFQLAFEMHMQENVASMARQYVRSVIASVQRVALALSPSSHQLSGLRPPPASPEAHTLARWISHSYRCYLGVDLLKPHGTDLLKSLWHHPDAVMCCSLKALSPVFTFANQAGLDMLETTLVALQDITLDKIFDNNNGKKTLSSEFPQIMQQGFMCMDGGICMSSMGRAVTYEKAVGWKVLNDDEDPHCICFMFLNWSFI

SEQ ID NO: 1051 - DNA, 977 bp, Arabidopsis thaliana
  G399,family:HB
aggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtgattttttattttagtggtgggaaaagggtgttttggtatttttcgttatcgttatatagtctatctgtgtggggtcattgttattttggatgattggccttctcatgaacta

SEQ ID NO: 1052 - protein, 283 aa, Arabidopsis thaliana
  G399,HB domain coordinates 126-186
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 1053 - DNA, 1577 bp, Arabidopsis thaliana
  G4,family:AP2
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgcattggtatctcatgagccttctcttccatagagagtttctcttttaattttgtcgaaataaaaaaggtgtgatgaagtaaatagaggtataataatatctatctattaagtcttgttttgttctttcatttttgtatttcttttctatttaaaagacagtttattagtcttctgagctctctttttgatctttgttatagcgtatcatcaccctcgaaagtgtaatgttttgtacccccaaacttgtttagcattataataaagtctctttg

SEQ ID NO: 1054 - protein, 375 aa, Arabidopsis thaliana
  G4,AP2 domain coordinates 121-183
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 1055 - DNA, 1364 bp, Arabidopsis thaliana
  G406,family:HB
agaagaatccccattgtctttaatttctctccatttctctttctctcttccttcaaagttttctcttttcttgatgggtttaagagagtaaagatcatcaagtactatgcattaaattgagaagttattaaaaatttcgaaagtaattaaagattgttgatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagaggcaccgtcgtctcctccacagtttcttgaacattctgatggtcttaattaccggagtttcacagatctacgtgatcttcttccattaaaggcggcggcttcttcattcgccgccgcagctggatcttcagacagtagcgattcaagcgctctgctgaatgaagaaagcagctctaatgtcactgtggcggctccggtgacggttccaggaggtaatttcttccagtttgtgaaaatggagcagacggaggatcatgaggactttctgagtggagaagaagcttgtgaattcttttccgatgaacaaccgccgtctctacactggtactccaccgttgatcattggaattgaagctgaaaacaccaccggaagagattttggattggattagatgctcttttcttctctgtggaaaaaacagaggagggcaaaatgggaataaagttaaaattgaagggtgaaagggcaattaaggaagggttaagtctgggcgggaataatgatttagggtgaatttgtaattatgctttttctctagtgattttcgtgcacttcttgtaattaaggatcatcagatcaaagagaaattgagaaggggttaacatgtcaaaaaaaaaaaa

SEQ ID NO: 1056 - protein, 311 aa, Arabidopsis thaliana
  G406,HB domain coordinates 58-118
MMKRLSSSDSVGGLISLCPTTSTDEQSPRRYGGREFQSMLEGYEEEEEAIVEERGHVGLSEKKRRLSINQVKALEKNFELENKLEPERKVKLAQELGLQPRQVAVWFQNRRARWKTKQLEKDYGVLKTQYDSLRHNFDSLRRDNESLLQEISKLKTKLNGGGGEEEEEENNAAVTTESDISVKEEEVSLPEKITEAPSSPPQFLEHSDGLNYRSFTDLRDLLPLKAAASSFAAAAGSSDSSDSSALLNEESSSNVTVAAPVTVPGGNFFQFVKMEQTEDHEDFLSGEEACEFFSDEQPPSLHWYSTVDHWN

SEQ ID NO: 1057 - DNA, 1302 bp, Arabidopsis thaliana
  G409,family:HB
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 1058 - protein, 272 aa, Arabidopsis thaliana
  G409,HB domain coordinates 64-124
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 1059 - DNA, 882 bp, Arabidopsis thaliana
  G411,family:HB
atggcctttcctcaacatggcttcatgtttcagcaactccatgaagacaatgctcatcacttaccttccccaacctctctcccctcttgtcctcctcatctcttctatggaggaggaggaaactacatgatgaacagatcaatgtcgttcacgggagtatcagatcattatcatctaactcaaaaaagcccgacaacaacgaacaacatgaatgatcaagaccaggtaggcgaggaagacaacctatcagacgatgggtcacatatgatgttaggagagaagaagaagaggctgaatttagagcaagttagggcattagagaagagcttcgagctagggaacaagctggagccagagaggaagatgcagcttgctaaggctttaggattgcagcctaggcagattgcaatatggtttcagaacaggagagctaggtggaagacaaagcagctcgagagagactatgattctctcaaaaaacagttcgatgttttgaaatcggacaatgattctcttcttgcccacaacaagaaactacatgctgagttagtggcattgaagaaacacgaccgtaaagaatcagcaaagatcaagagagaattcgcagaagcttcatggagcaacaatgggagcacagaaaataatcataacaataatagttcagacgctaatcatgtgagcatgatcaaagatcttttcccttcttcgatccgatccgcgaccgcgaccacggcctctacccatattgatcatgagattgttcaagatcaagatcaagggttttgcaatatgttcaatggtattgatgaaacgacgtcggctagttattgggcatggcctgaccagcagcaacaacatcacaatcatcatcagttcaattga

SEQ ID NO: 1060 - protein, 293 aa, Arabidopsis thaliana
  G411,HB domain coordinates NA
MAFPQHGFMFQQLHEDNAHHLPSPTSLPSCPPHLFYGGGGNYMMNRSMSFTGVSDHYHLTQKSPTTTNNMNDQDQVGEEDNLSDDGSHMMLGEKKKRLNLEQVRALEKSFELGNKLEPERKMQLAKALGLQPRQIAIWFQNRRARWKTKQLERDYDSLKKQFDVLKSDNDSLLAHNKKLHAELVALKKHDRKESAKIKREFAEASWSNNGSTENNHNNNSSDANHVSMIKDLFPSSIRSATATTASTHIDHEIVQDQDQGFCNMFNGIDETTSASYWAWPDQQQQHHNHHQFN

SEQ ID NO: 1061 - DNA, 1169 bp, Arabidopsis thaliana
  G413,family:HB
gagaagttcatggaggttctgattccggtcgatgagatgacagaaggtggagaatattctccggcgatgatgtcagcagagccattcttgaccatgaagaagatgaagaagagcaaccacaacaagaacaatcagagaaggtttagcgacgagcagatcaagtcactggagatgatgtttgagtctgagacaaggcttgagccaaggaagaaggttcaattagctagagagctagggttgcagccgaggcaagtggctatatggtttcagaacaagagggctcgttggaaatccaagcagctcgagactgagtacaacattctcagacaaaactacgacaacttggcttctcagttcgagtccttaaagaaagaaaaacaagctttagtctctgagttgcagaggctaaaagaggcgacgcaaaagaagacacaggaggaggaaaggcagtgtagtggagatcaagcggtggttgctctaagcagcacacatcatgaatcagaaaacgaagagaaccggaggcgtaaaccggaagaggttagaccggagatggagatgaaagatgataagggtcatcatggggttatgtgtgatcatcatgattatgaagatgatgataatggttatagtaacaacatcaagagagagtattttggtgggtttgaggaagaaccagatcacttaatgaacattgttgaaccagctgatagttgtttgacatcatctgatgattggagaggtttcaaatcagatactactactctcttggaccaatccagcaacaattacccttggcgggatttttggtcatgaaaacaataaactctaaacaagaagatgaaacagattgagactaaagattggatatatacatattcaaatcgaaatttaccggtctacatcgcatgaaccgagccacggatatagagatattcggtccagcaaatgactcgtttctcagcgagaattttgcaggattttgagctgaaattgtatggttttgtctgtataaatgatgtgtttagaaagacgtatattctcagttcgtgtttgtaattctgtttttaagtagtaagtactcgtcatgctttgtagctaagtagtaagtttaagactaaatttggatgaataaaaatcaaaagcaggagaaatcataaaaaaaaaaaaaa

SEQ ID NO: 1062 - protein, 267 aa, Arabidopsis thaliana
  G413,HB domain coordinates 37-97
MEVLIPVDEMTEGGEYSPAMMSAEPFLTMKKMKKSNHNKNNQRRFSDEQIKSLEMMFESETRLEPRKKVQLARELGLQPRQVAIWFQNKRARWKSKQLETEYNILRQNYDNLASQFESLKKEKQALVSELQRLKEATQKKTQEEERQCSGDQAVVALSSTHHESENEENRRRKPEEVRPEMEMKDDKGHHGVMCDHHDYEDDDNGYSNNIKREYFGGFEEEPDHLMNIVEPADSCLTSSDDWRGFKSDTTTLLDQSSNNYPWRDFWS

SEQ ID NO: 1063 - DNA, 2745 bp, Arabidopsis thaliana
  G415,family:HB
cctcaaactcaccccacccgagttttctttctcaatctcgcgggcgagggaaaaggaatctacaagtatttaaacctttgctgatttagaaacgcctgagtgcatcatcttcgaggatagcagtataaacatagctagttgattgtagagaatgtataaagcagtaagtaagcgggtaactagaagtagtggatctggtttgaagcagacaaatgtagataatggaggagagattagtccaactgttgacagagtatctgaacaaggcaaatcatcagaggcagggagtcacatgccaactgatgcaaacggaaatggacatttgcatcatgagttatggatcatggaaaggggaatgaagaacagaaaccaacccctcaaaccgtgaagaaggattctaataccaataccaaattttcagggtctcatcgtgagcttgtcatcggtcttccttgccgtggacaatttgaaatccacaaccggtccagggcatctacgagttcgaagaggttaggaggaggtggagaaaggaatgtgttgtttgcaagtcacaagagagctcagagatctaaggaagatgctggaccatcttcggttgttgctaattccacacctgtaggtcgaccaaagaaaaagaacaagactatgaacaaaggacaagttagagaagatgatgagtacacaagaatcaaaaagaaacttcgatactttctaaaccggattaactatgagcaaagcctaattgacgcctattcgttagaaggctggaaaggttcaagcctggaaaagataaggccagagaaagagcttgaacgagccacaaaggaaattttgcgggcaagcttaaaattagatctttttcagcaccttgacacactctgtgctgaaggaagccttccagagtctttatttgatactgatggagagatttctagcgaggatatcttctgtgcaaaatgtggttcaaaggacttgtctgttgataatgatatcatactatgcgatgggttttgcgatcgaggctttcaccaatactgtcttgaaccacctctgcggaaagaagatattcctccggatgatgagggttggctatgccccggatgtgattgcaaagatgacagcttggacttgcttaatgattctttagggacaaaattttcggtcagcgacagttgggagaaaatatttcctgaggcagcagcagcgctggttggtggaggtcaaaatcttgactgtgatcttccttcagctgattctgatgatgaagagtatgatccagattgtttgaatgataatgaaaatgatgaagatggcagtgatgacaatgaagaatctgagaacgaagatggtagttctgatgaaactgaattcacatctgcatctgacgaaatgattgagtcatttaaagaagggaaagatataatgaaagatgtaatggcccttccatctgatgattctgaggatgatgactatgatcctgatgccccgacttgtgatgatgataaagaaagttcaaattctgattgtacatcagacactgaagatcttgaaacttccttcaaaggagatgagactaatcagcaagctgaagatacaccacttgaggatcctggcagacagacgtctcagctccaaggtgatgcaattttagagtcagatgttgggcttgatgatggtcctgccggtgtatccagaaggaggaatgttgaaaggctggattacaaaaagttgtatgatgaggaatatgacaatgttccgacttcgtcaagtgatgatgacgattgggataaaactgcaagaatgggaaaagaagattccgagtcggaagatgaaggggacactgtacctctgaaacagtcttcaaatgcagaagatcatacttctaagaaacttatacggaagtcgaaaagggcagataaaaaggataccttagaaatgccacaagaaggtcctggagaaaatggtggttctggtgaaattgaaaaaagcagctcttcagcatgtaaacagacagatcccaaaactcagagactgtacatatcttttcaagagaatcaatatccagacaaagccacgaaggagagcttagccaaagagctacaaatgacagttaagcaagttaataactggtttaagcataggcgttggtcgataaacagcaaacctttagtttcagaggaaaatgtcgagaagttaaaaacaggcaaggaaggtgaatgtgagacatctgttgctggaagtagcaaacaaactatggaaaccgagtcagttgcagagaaaccaaccaatactggatcacggaaaagaagaagaaagtagactttagattcaatcatgaaggttttagatctaatgcaaggacaatactggaacacatacttacccaaaccccgagatatgaagacaccaaaccctgcaaagcatcgggtttgttcagttctttgtttcacatttttggggtactttgaagaccttgaaatttgaggcaaaagaaagaaagaaagattttcttcgaaattggatgataggttcatttttaacagttaaagaagttaaggctttgtgttatgattatgaaagtttttgtttatttccatctggagagatgttttgagttatggtttctgtaatcgatagagaccggtttaagagatcaagagatttaaactttaaaagtcttgtttgaaccggttttaaaccctcaaatgtgaacgtttaaccggtctgtaattgcttattattaaa

SEQ ID NO: 1064 - protein, 660 aa, Arabidopsis thaliana
  G415,HB domain coordinates 550-610
MDHGKGNEEQKPTPQTVKKDSNTNTKFSGSHRELVIGLPCRGQFEIHNRSRASTSSKRLGGGGERNVLFASHKRAQRSKEDAGPSSVVANSTPVGRPKKKNKTMNKGQVREDDEYTRIKKKLRYFLNRINYEQSLIDAYSLEGWKGSSLEKIRPEKELERATKEILRASLKLDLFQHLDTLCAEGSLPESLFDTDGEISSEDIFCAKCGSKDLSVDNDIILCDGFCDRGFHQYCLEPPLRKEDIPPDDEGWLCPGCDCKDDSLDLLNDSLGTKFSVSDSWEKIFPEAAAALVGGGQNLDCDLPSADSDDEEYDPDCLNDNENDEDGSDDNEESENEDGSSDETEFTSASDEMIESFKEGKDIMKDVMALPSDDSEDDDYDPDAPTCDDDKESSNSDCTSDTEDLETSFKGDETNQQAEDTPLEDPGRQTSQLQGDAILESDVGLDDGPAGVSRRRNVERLDYKKLYDEEYDNVPTSSSDDDDWDKTARMGKEDSESEDEGDTVPLKQSSNAEDHTSKKLIRKSKRADKKDTLEMPQEGPGENGGSGEIEKSSSSACKQTDPKTQRLYISFQENQYPDKATKESLAKELQMTVKQVNNWFKHRRWSINSKPLVSEENVEKLKTGKEGECETSVAGSSKQTMETESVAEKPTNTGSRKRRRK

SEQ ID NO: 1065 - DNA, 1886 bp, Arabidopsis thaliana
  G421,family:HB
atttagttataaaatgttgctatttgttgatctagtgctctgaatcttttagtgaggcagatgatgaagattatgaatttcttcatgaaattattgtaagaaaaagaacatagagaagctgcggaatgaaagtacactgttctttcacggagaaagaagataaataagcattatcttcttcttcagtttttaacacacattttggaaattttgatgtaaaaattctctttggaacgttgtgttgtctgaaatcttcccaaaggttctatcagaagaagaaggataaagtttcatagaaacccaatggacaacaacaacaacaacaacacttttagttctctggataatgtcatgactaaccaaaatcctcttctcatggattttataccttcaagagaagattcaacttcattctcaacaatgcttccatggaataccatcagatcagatcctctacaaatgggtggctttgatattttcaattctatgctgactaacaaatacttatcatcttctccacggtctatcgatgttcaagataaccgcaatgttgagttcatggctcctcctcctcatcctcctccacttcatcctttggatcatttaagacactatgatgattcctcaaacaacatgtggggttttgaagcaaatagtgagtttcaggcattttcaggtgtagttggtccaagtgaaccaatgatgtctacattcggtgaagaagatttcccgtttctaatttcgaataaaagaaacaatgagctttcattgagtcttgcatcagatgtttctgatgaatgctcggagataagtctttgtgcagctacaagattagcctcagagcaagcttcttgcagcagcaaagacatttctaataacgttgttactcaaggtttctctcaacttatatttggctcaaaataccttcactctgttcaagaaatactatctcatttcgccgcatactcgctcgattattcatctcgaggaaccgagtcaggagctgctagttcagcctttacttcacgttttgagaatataactgagtttcttgatggtgattctaataactcggaggcgggtttcggatctacatttcaaaggagagcattagaagcaaagaaaacccatctcttggatcttcttcaaatggtggatgatcgatatagtcattgcgtagatgagattcatacggttatatcagcgttccatgctgcaaccgagttagatccacagttacacacccggtttgccctccaaaccgtttccttcttatacaagaacctgagagagagaatctgcaagaagataatctctatgggatctgtattggagagaggcaaagacaagactcaagaaacctctatgttccaccagcattgccttcttcagcagctgaaacgaaagaaccatcagatttggagacctcaacgaggtttgcctgagaaatctgtttcggttctacggaattggatgttccaaaacttccttcacccttacccgaaagattcggagaaacatcttctagctatacgaagtggcttgacaagaagtcaggtatcaaactggtttataaatgcgcgggttaggctatggaagccgatgatagaagagatgtatgcggaaatgaacaagaggaagctcaataacagtcacattcaacccaacggaccaactcttcgaatgccaaaatctgttatgatgagccaagcaatgcataaataagacaacaattgtgtttaccaactttgtgataattaggcaattgctactctatgattgcccaaaacctaaaccatgtacgactatcattacgtatgttataattgtatatacaactcctttatctttgactatttcattttattaaaaaaaaaaaaaaaaaa

SEQ ID NO: 1066 - protein, 473 aa, Arabidopsis thaliana
  G421,HB domain coordinates 371-434
MDNNNNNNTFSSLDNVMTNQNPLLMDFIPSREDSTSFSTMLPWNTIRSDPLQMGGFDIFNSMLTNKYLSSSPRSIDVQDNRNVEFMAPPPHPPPLHPLDHLRHYDDSSNNMWGFEANSEFQAFSGVVGPSEPMMSTFGEEDFPFLISNKRNNELSLSLASDVSDECSEISLCAATRLASEQASCSSKDISNNVVTQGFSQLIFGSKYLHSVQEILSHFAAYSLDYSSRGTESGAASSAFTSRFENITEFLDGDSNNSEAGFGSTFQRRALEAKKTHLLDLLQMVDDRYSHCVDEIHTVISAFHAATELDPQLHTRFALQTVSFLYKNLRERICKKIISMGSVLERGKDKTQETSMFHQHCLLQQLKRKNHQIWRPQRGLPEKSVSVLRNWMFQNFLHPYPKDSEKHLLAIRSGLTRSQVSNWFINARVRLWKPMIEEMYAEMNKRKLNNSHIQPNGPTLRMPKSVMMSQAMHK

SEQ ID NO: 1067 - DNA, 1751 bp, Arabidopsis thaliana
  G426,family:HB
agagagagaactagtctgtgtcttttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttgggttatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcaaaaaaaaa

SEQ ID NO: 1068 - protein, 431 aa, Arabidopsis thaliana
  G426,HB domain coordinates 346-406
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSRSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 1069 - DNA, 1379 bp, Arabidopsis thaliana
  G428,family:HB
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 1070 - protein, 311 aa, Arabidopsis thaliana
  G428,HB domain coordinates 229-292
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 1071 - DNA, 909 bp, Arabidopsis thaliana
  G43,family:AP2
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 1072 - protein, 201 aa, Arabidopsis thaliana
  G43,AP2 domain coordinates 104-172
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 1073 - DNA, 1197 bp, Arabidopsis thaliana
  G432,family:HB
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 1074 - protein, 398 aa, Arabidopsis thaliana
  G432,HB domain coordinates NA
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 1075 - DNA, 627 bp, Arabidopsis thaliana
  G435,family:HB
aacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattccaatatatatagtcttgtctctgttttgtttcgtttgatctgtttctctttgtctgaatagatttaaaatttgtaattaaagtcattcagacattcacta

SEQ ID NO: 1076 - protein, 156 aa, Arabidopsis thaliana
  G435,HB domain coordinates 4-67
MENSQSQGKNKKKRLTQDQVRQLEKCFTMNKKLEPDLKLQLSNQLGLPQRQVAVWFQNKRARFKTQSLEVQHCTLQSKHEAALSDKAKLEHQVQFLQDELKRARNQLALFTNQDSPVDNSNLGSCDEDHDDQVVVFDELYACFVSNGHGSSSTSWV

SEQ ID NO: 1077 - DNA, 1507 bp, Arabidopsis thaliana
  G440,family:AP2
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 1078 - protein, 354 aa, Arabidopsis thaliana
  G440,AP2 domain coordinates 122-184
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 1079 - DNA, 949 bp, Arabidopsis thaliana
  G443,family:IAA
ctagacaaccacaagaacacaaaacacacaaaaacaaagaggttctttctttgaagaagaaatggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaaggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagatgtttgtttcgtcttgtaagaggctaaggatcatgaaaggatctgaagttaaaggtttaggttgtggtggtctttaacaaacctaattgagagataaagatcaaagagaaagattcaaaaacagagttttttgttctgtttcttgaaacagagtaaatatagctctgaaactgctcgggttcttggggagagatgtttcatacaatcatactttgtgaatgtttacctcatcggtaaaaagagagatgcttaaaatggtcttaagcataaaagtgtgagaaagatctaaatctaaactttagctgtaactctgtctccattaaagagaaaggttttgtggtattagaaagatctaatctgaagattatctttgtgtttttcactttttaaaaaaaaaaaaaaaa

SEQ ID NO: 1080 - protein, 186 aa, Arabidopsis thaliana
  G443,IAA domain coordinates NA
MEKVDVYDELVNLKATELRLGLPGTEETVSCGKSNKRVLPEATEKEIESTGKTETASPPKAQIVGWPPVRSYRKNNVQTKKSESEGQGNYVKVSMDGAPYLRKIDLTMYKQYPELMKSLENMFKFSVGEYFEREGYKGSDFVPTYEDKDGDWMLVGDVPWEMFVSSCKRLRIMKGSEVKGLGCGGL

SEQ ID NO: 1081 - DNA, 977 bp, Arabidopsis thaliana
  G449,family:IAA
agcttctctatatctctcctctctttcaaggataataaccaaaagcttttctttttatcttctcctgcaattcttgaagaaatggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatgagatatatcttcaagaaatctaacagagacacaaaagaacttgaagaaaaatagagtttcttttggttcagagaaatctctgtctgtgcttgggttgtcgggtttctcgggcaagatctatgttcattggattgaatccaattcatagcctttatttacctcatcggtaaaattcaaatgtaaacatgcttaatggtcttaagcatatgaaactggaacctaattacattttgtttcagaaacagggcaaaaggttgtccttaaatctttggttatgtgtattacattaattaaagtgttatgaagattgaagagttgtttttaaaa

SEQ ID NO: 1082 - protein, 189 aa, Arabidopsis thaliana
  G449,IAA domain coordinates NA
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 1083 - DNA, 988 bp, Arabidopsis thaliana
  G450,family:IAA
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 1084 - protein, 228 aa, Arabidopsis thaliana
  G450,IAA domain coordinates 6-14,78-89,112-128,180-217
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 1085 - DNA, 697 bp, Arabidopsis thaliana
  G451,family:IAA
tcaagaattaaggaagagagcttcttcgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaaaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctg

SEQ ID NO: 1086 - protein, 168 aa, Arabidopsis thaliana
  G451,IAA domain coordinates 12-20,57-68,76-92,131-164
MEVTNGLNLKDTELRLGLPGAQEEQQLELSCVRSNNKRKNNDSTEESAPPPAKTQIVGWPPVRSNRKNNNNKNVSYVKVSMDGAPYLRKIDLKMYKNYPELLKALENMFKFTVGEYSEREGYKGSGFVPTYEDKDGDWMLVGDVPWDMFSSSCQKLRIMKGSEAPTAL

SEQ ID NO: 1087 - DNA, 951 bp, Arabidopsis thaliana
  G452,family:IAA
tccgcaagaacaagaacaagaagaagaagaacaagacaagaagaacaaagtacccaagaaaacacacagggaaggaaacacaaagattgatattgatccaaaagcaatggcgtacgagaaagtcaacgagcttaaccttaaggacacagagctatgtcttggattacccggaagaacagagaagatcaaagaagaacaagaggtttcttgcgttaaaattaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatgatccagagaagctgagaatcttttgtctaaaaaggagatgatgactatgatcgatgaatgaaaaaccctttttggtttgattcggatcggagtttgactaaagttgaccgtgaaagacgaaacttcggggttttgtccgacgagagatccatctctagtgatgttctttttgtttttgtatttagatttgaagtttgatgtaaagatacatgagattttatgtataatacggacacatacacaatctatagatgtataatgtattaagtagttatgtcctataagatcatcagttttctgttaaaaaaaaaaaaaaaaaaa

SEQ ID NO: 1088 - protein, 174 aa, Arabidopsis thaliana
  G452,IAA domain coordinates NA
MAYEKVNELNLKDTELCLGLPGRTEKIKEEQEVSCVKINNKRLFEETRDEEESTPPTKTQIVGWPPVRSSRKNNNSVSYVKVSMDGAPYLRKIDLKTYKNYPELLKALENMFKVMIGEYCEREGYKGSGFVPTYEDKDGDWMLVGDVPWDMFSSSCKRLRIMKGSDAPALDSSL

SEQ ID NO: 1089 - DNA, 1262 bp, Arabidopsis thaliana
  G463,family:IAA
ctcgagctacgtcaggggtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaaaaaccctgacgtagcctcgag

SEQ ID NO: 1090 - protein, 246 aa, Arabidopsis thaliana
  G463,IAA domain coordinates 14-23,77-88,130-146,194-227
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 1091 - DNA, 1239 bp, Arabidopsis thaliana
  G467,family:IAA
ggttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatcctaatggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagttgtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatgaagaaaaagatcttttacagcttttaaagaagtagagagatgttattaattgcattttgcctttaaactttgatgagtttttggtcttggaaaagtttctgatataagtctgatgtacattctggtttgttacatcttcttttggcttttgagatatcatagagttttgttggaactcaaagaccaaacagtgcaatgatgattttggggtcttgagtaaatttacaaacccttttaggcaaa

SEQ ID NO: 1092 - protein, 267 aa, Arabidopsis thaliana
  G467,IAA domain coordinates NA
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 1093 - DNA, 733 bp, Arabidopsis thaliana
  G468,family:IAA
ttactcatttgtcttaacctaaaattattataaaaaggatagagagagagagagagagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatatttataatattattttcatttttctttaaaaaaaaaaaaaaaaaaaaaaaaaaa

SEQ ID NO: 1094 - protein, 175 aa, Arabidopsis thaliana
  G468,IAA domain coordinates 86-102,141-171
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 1095 - DNA, 785 bp, Arabidopsis thaliana
  G47,family:AP2
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 1096 - protein, 144 aa, Arabidopsis thaliana
  G47,AP2 domain coordinates 10-75
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 1097 - DNA, 832 bp, Arabidopsis thaliana
  G481,family:CAAT
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 1098 - protein, 141 aa, Arabidopsis thaliana
  G481,CAAT domain coordinates 20-109
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 1099 - DNA, 1065 bp, Arabidopsis thaliana
  G482,family:CAAT
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 1100 - protein, 190 aa, Arabidopsis thaliana
  G482,CAAT domain coordinates 26-115
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 1101 - DNA, 684 bp, Arabidopsis thaliana
  G485,family:CAAT
cctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 1102 - protein, 161 aa, Arabidopsis thaliana
  G485,CAAT domain coordinates 20-109
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 1103 - DNA, 927 bp, Arabidopsis thaliana
  G489,family:CAAT
gaattcggcacgagacccaccaagaggatcaaccagtctcttccccttcagattctcctttccacagtaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaagcacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttcccgcttcttttaggcctaccttgtagtcttggggttttgtttctgttttcgaataatggtaacctttgtataacttatttcagtatcgtctcagtttggtactatgtcagttttggtaaaaaaaaaaaaaaaaaaaaaaaaaa

SEQ ID NO: 1104 - protein, 231 aa, Arabidopsis thaliana
  G489,CAAT domain coordinates 68-164
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 1105 - DNA, 1207 bp, Arabidopsis thaliana
  G501,family:NAC
aaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaa

SEQ ID NO: 1106 - protein, 283 aa, Arabidopsis thaliana
  G501,NAC domain coordinates 10-131
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 1107 - DNA, 1038 bp, Arabidopsis thaliana
  G508,family:NAC
gctttaaaaagaaccaaacctttataagtgttttttagacattgggagagatgggaaaagatattgagctcccgggttttaggttccacccgactgaggaagagcttcttgatttctacctcaagaacatggtttacggtaagagatcgagtgtcgaagtcattggtttccttaacatataccgtcatgatccatgggacttacctggtttatcgagaatcggggagagggaatggtacttctttgtaccaagggaaaggaagcatgggaacggtgggaggccaagcaggacaactgaaaaaggatattggaaagcaactggatccgatcgtaaaatcataagcttgtctgagccaaaacgtgttatagggctcaagaagacgcttgtgttctatagaggaagagcaccaggaggaagcaagactgattgggtgatgaacgagtttcggatgcccgataattgctccttaccaaaggatgttgtgctttgtaagatatatagaaaagctacttcattgaaagtattggagcaaagggcagagatggaagctaagatgaatcaaacatgtcctaactctcctctttcgtcttccgagacgatttctttcgttggtaaagaagaaaacatgatgacttcgttccgtgctcctcaagtaatagctatggaagaagcaaacaagatccaaatgcatcaagaaaacgcgaaaaccgaagagaaacaaagagaagcagagaccaaagaaccttcttcatcactgaagctaccgtttggaagtttaccagagctacaattaccaaaaccaggagtagaatgggaccagttgttgagtataagcccatggctccagaatcttacaccaatagttaacatatattggtaggatatgtaaagaacaaatacatttaaatattcttactctcgtaaaaaacagagcttgtaccaaatagtatttactaaacttttatgtatcttttgtaattttgtaacataagaaaatttgtaacactatttatagtcatatttgacgatcatttctt

SEQ ID NO: 1108 - protein, 276 aa, Arabidopsis thaliana
  G508,NAC domain coordinates NA
MGKDIELPGFRFHPTEEELLDFYLKNMVYGKRSSVEVIGFLNIYRHDPWDLPGLSRIGEREWYFFVPRERKHGNGGRPSRTTEKGYWKATGSDRKIISLSEPKRVIGLKKTLVFYRGRAPGGSKTDWVMNEFRMPDNCSLPKDVVLCKIYRKATSLKVLEQRAEMEAKMNQTCPNSPLSSSETISFVGKEENMMTSFRAPQVIAMEEANKIQMHQENAKTEEKQREAETKEPSSSLKLPFGSLPELQLPKPGVEWDQLLSISPWLQNLTPIVNIYW

SEQ ID NO: 1109 - DNA, 1812 bp, Arabidopsis thaliana
  G513,family:NAC
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaaaaaaaaaaaaaaaa

SEQ ID NO: 1110 - protein, 451 aa, Arabidopsis thaliana
  G513,NAC domain coordinates 16-161
MKEDMEVLSLASLPVGFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKLFKKQDIVNGAAEPEESKSCEVEPAVSSPTVVDEVEMSEVSPVFPKTEETNPCDVAESSLVIPSECRSGYSVPEVTTTGLDDIDWLSFMEFDSPKLFSPLHSQVQSELGSSFNGLQSESSELFKNHNEDYIQTQYGTNDADEYMSKFLDSFLDIPYEPEQIPYEPQNLSSCNKINDESKRGIKIRARRAQAPGCAEQFVMQGDASRRLRLQVNLNSHKSETDSTQLQFIKKEVKDTTTETMTKGCGNFTRSKSRTSFIFKKIAAMGCSYRGLFRVGVVAVVCVMSVCSLVA

SEQ ID NO: 1111 - DNA, 1254 bp, Arabidopsis thaliana
  G519,family:NAC
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 1112 - protein, 269 aa, Arabidopsis thaliana
  G519,NAC domain coordinates 10-131
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 1113 - DNA, 1250 bp, Arabidopsis thaliana
  G522,family:NAC
cgtcgacgtgtcctatacacatatctataattccacaggttgaagaaaagaaataatggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttgataaaagataacactataatatggtgcgtaacgtttgctatataggtaccgtagaatttagc

SEQ ID NO: 1114 - protein, 377 aa, Arabidopsis thaliana
  G522,NAC domain coordinates 10-165
MESVDQSCSVPPGFRFHPTDEELVGYYLRKKVASQKIDLDVIRDIDLYRIEPWDLQESCRIGYEERNEWYFFSHKDKKYPTGTRTNRATMAGFWKATGRDKAVYDKSKLIGMRKTLVFYKGRAPNGQKTDWIMHEYRLESDENAPPQEEGWVVCRAFKKKPMTGQAKNTETWSSSYFYDELPSGVRSVTEPLNYVSKQKQNVFAQDLMFKQELEGSDIGLNFIHCDQFIQLPQLESPSLPLTKRPVSLTSITSLEKNKNIYKRHLIEEDVSFNALISSGNKDKKKKKTSVMTTDWRALDKFVASQLMSQEDGVSGFGGHHEEDNNKIGHYNNEESNNKGSVETASSTLLSDREEENRFISGLLCSNLDYDLYRDLHV

SEQ ID NO: 1115 - DNA, 1179 bp, Arabidopsis thaliana
  G525,family:NAC
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 1116 - protein, 285 aa, Arabidopsis thaliana
  G525,NAC domain coordinates 23-167
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 1117 - DNA, 639 bp, Arabidopsis thaliana
  G527,family:NAC
ctctctcatttgactcgaggaaatttcagaagaagaagatgatgccgatgactgaagaattttacgatgaagaggaagagcttggttgctttagatttaatccttcagaagaagaactcatactcgattatcttctaccaaagcttggcttccaccaaccaaacacgatatatttgttagaagacagggacaacatctacgccaaagagccgtggcggcttaatcacacagagaatgatatctttgaacctaacgagtggttttatttcgtgaaaaggacaaatcgcaaagttaaaggttggaaagccactggagagttaaaagatgtcgtgtcgaagaaaaccggtgaagtgatcgggaagaagaggaatctcaggttctacgttgaaggtgatgagagcaaaacgagtggttggaccatgagggagtattcttccattggcaatcaaaaccaacgtctctgccaccttaaaggaccatgattctgtttggtgaatatccctcaaaaatatgatgattatggaaaacgatgacttcttttttttttttttttttctaaaggtagttacgttactcatcatcattttatttcgttgtgtttcgtttgaagattctcccgtattcttatatctttattag

SEQ ID NO: 1118 - protein, 147 aa, Arabidopsis thaliana
  G527,NAC domain coordinates NA
MMPMTEEFYDEEEELGCFRFNPSEEELILDYLLPKLGFHQPNTIYLLEDRDNIYAKEPWRLNHTENDIFEPNEWFYFVKRTNRKVKGWKATGELKDVVSKKTGEVIGKKRNLRFYVEGDESKTSGWTMREYSSIGNQNQRLCHLKGP

SEQ ID NO: 1119 - DNA, 990 bp, Arabidopsis thaliana
  G529,family:GF14
gcaaagatgtcttctgattcgtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgtgattggtgctaggagagcttcttggaggattatctcttccattgagcagaaggaagatagcaggggcaacagtgatcatgtttcgattatcaaggattacagaggcaagattgaaactgagctcagcaagatttgtgatggcattttgaaccttcttgaggctcatctcattcctgctgcttctttggctgagtccaaagttttttacctgaagatgaagggagattatcatcggtaccttgctgaattcaagactggtgctgagaggaaagaagctgctgagagcactcttgttgcctacaagtctgctcaggatattgctcttgctgatctggctcccactcacccaatcagactggggcttgctcttaacttctctgttttctactatgagattctcaactcatctgatcgtgcgtgtagtctcgcaaagcaggcttttgatgaggcaatctcggagctagacacattgggagaggaatcatacaaggacagtacattgatcatgcagcttctccgtgacaatctcaccctctggacttctgacctcaatgacgaagctggtgatgatatcaaggaagccccgaaagaggtgcagaaagttgatgaacaagcccaaccaccaccttcgcagtgataaaatcagatccatggaatgatttgcagacaaaaagatatatggcttggttctgtgtttttaaacagaaaaaaaccttgtagtttccttaaacatgggctgtagtttccttaaacatggatttgtagtagtaattgtagctgcatgatttggttatcgatggttaaaaaaaaaaaa

SEQ ID NO: 1120 - protein, 268 aa, Arabidopsis thaliana
  G529,GF14 domain coordinates 229-236
MSSDSSREENVYLAKLAEQAERYEEMVEFMEKVAKTVETEELTVEERNLLSVAYKNVIGARRASWRIISSIEQKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNFSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 1121 - DNA, 792 bp, Arabidopsis thaliana
  G530,family:GF14
atgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgagcgaggaatcctacaaagatagcaccttaataatgcaactccttagggacaatctgaccttgtggacttctgacatctcagaagaaggaggagacgatgctcataagacgaatggttctgccaaacctggtgctggtggagacgatgcagagtga

SEQ ID NO: 1122 - protein, 263 aa, Arabidopsis thaliana
  G530,GF14 domain coordinates 227-235
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLSEESYKDSTLIMQLLRDNLTLWTSDISEEGGDDAHKTNGSAKPGAGGDDAE

SEQ ID NO: 1123 - DNA, 1069 bp, Arabidopsis thaliana
  G531,family:GF14
ccacgcgtccgcgacaaatccctaattccaaaatcctctcggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtccaaaaaaaaaaaaaaaaaaaaaaaaaaaaaaaaa

SEQ ID NO: 1124 - protein, 265 aa, Arabidopsis thaliana
  G531,GF14 domain coordinates 227-234
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 1125 - DNA, 1100 bp, Arabidopsis thaliana
  G532,family:GF14
gcggccgcgtcgacgaaggaagaagaagaagaagaagaagaaaaaactatggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgaaaggagattactatcgctatcttgcggagttcagttctggtgctgaacgcaaggaagctgcagatcagtctcttgaagcatataaggctgctgttgctgctgcagagaatggtttggcacccacacatccagttagacttggcttggcgttgaacttttcagttttctactatgagatcttgaactctcccgaaagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggagatgagagaaccaaaggtgctgatgagcctcaagatgagaactaaatcctctgtgagaagagaaacgactcttgctgcatcctgaatcttgaagtgaagacagtaagtgtcgttgtttgttactcgaatgtgtaatttttaatctatgtctttcttgatggtgttttccagattcttgaacttttcacaacacaacactgcgttgcgtatcttcaaccctcttatgatgtggttgaattctgttttacgcttagtttgcttcttttgttgttgaattgagccagcaggcatgatttgggtttttgtttatcagaatattaggcgtaaaaaaa

SEQ ID NO: 1126 - protein, 254 aa, Arabidopsis thaliana
  G532,GF14 domain coordinates NA
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGDERTKGADEPQDEN

SEQ ID NO: 1127 - DNA, 922 bp, Arabidopsis thaliana
  G547,family:Z-C2H2
ttcctctacgtgctcacaatgaacaacaatcattcctatgatgatcgcagttttcacattccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcttgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatccttacgttttcagggcatcataagtgtaatatctgttttagagtgttctcgagtggtcaagctttaggaggtcacatgagatgtcattgggaaaaggaggaggagccgatgatcagtggtgctttggatttgaatgttcctccaacaatacaggatctttctacttcggacacatcagggtgttgtttagatcttaggttaggactctaattagtatctatatatatatataatgtctgtaggtatattggatgtttcc

SEQ ID NO: 1128 - protein, 284 aa, Arabidopsis thaliana
  G547,Z-C2H2 domain coordinates 79-99,164-184,222-244
MNNNHSYDDRSFHIPLHPSNTSNPNPNLQFALSSSYDHSPKKKRTKTVASSSSSSPKSASKPKYTKKPDPNAPKITRPCTECGRKFWSWKALFGHMRCHPERQWRGINPPPNYRVPTAASSKQLNQILPNWVSFMSEEDHEVASCLLMLSNGTPSSSSIERFECGGCKKVFGSHQALGGHRASHKNVKGCFAITNVTDDPMTVSTSSGHDHQGKILTFSGHHKCNICFRVFSSGQALGGHMRCHWEKEEEPMISGALDLNVPPTIQDLSTSDTSGCCLDLRLGL

SEQ ID NO: 1129 - DNA, 1529 bp, Arabidopsis thaliana
  G553,family:bZIP
ttgatcggaatattccttttagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagaccctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcattgatgattttgtttacttgaaaggaataagagatgtgtaaatttgggtggaaaacatgtaatgtctttgatgcattaggctctttatttgtaaaatatatagggtttgttgtcactcatctcctcgtatatgaaaatttgagcccacaatcaaattttttgtct

SEQ ID NO: 1130 - protein, 384 aa, Arabidopsis thaliana
  G553,bZIP domain coordinates 94-160
MEMMSSSSSTTQVVSFRDMGMYEPFQQLSGWESPFKSDINNITSNQNNNQSSSTTLEVDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 1131 - DNA, 1457 bp, Arabidopsis thaliana
  G556,family:bZIP
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 1132 - protein, 364 aa, Arabidopsis thaliana
  G556,bZIP domain coordinates 83-143
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 1133 - DNA, 1638 bp, Arabidopsis thaliana
  G558,family:bZIP
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 1134 - protein, 330 aa, Arabidopsis thaliana
  G558,bZIP domain coordinates 45-105
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 1135 - DNA, 1407 bp, Arabidopsis thaliana
  G559,family:bZIP
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 1136 - protein, 398 aa, Arabidopsis thaliana
  G559,bZIP domain coordinates 203-264
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 1137 - DNA, 1554 bp, Arabidopsis thaliana
  G562,family:bZIP
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 1138 - protein, 382 aa, Arabidopsis thaliana
  G562,bZIP domain coordinates 253-315
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 1139 - DNA, 916 bp, Arabidopsis thaliana
  G563,family:bZIP
attgttctttctctttgacaaaacccagatagataaaaattcgttccaattccagtgagctccggaaatggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttacggcggaggagtcaacgattacactttcgcgtctgattcaaagcccttcgagatggcgattgatgttgatcggagtatcggagatcggaacagcgttaacaacggaaagagtgttgacgatgtttggaaagagattgtatctggagagcaaaagacgatcatgatgaaggaagaagaaccagaagatataatgacacttgaggatttcttagcgaaagcagaaatggacgagggagcttcagatgaaatcgatgtgaagattccaacggagagactcaacaacgacggtagctatacatttgattttccgatgcagcgacacagttcgttccagatggttgaaggatcaatgggtggaggagtaacgagaggaaagagagggagagtgatgatggaggcaatggataaagctgcagctcagagacagaagaggatgatcaagaaccgtgaatccgctgctaggtctcgagagaggaaacaggcttatcaggttgagttagagactttggctgccaagttagaggaggagaatgagcagcttttgaaggagattgaagagagcactaaagagagatacaagaagctcatggaggttctgattccggtcgatgagaaaccaaggccaccgtcgaggcccttaagcaggagccattccttggaatggtgaagtgtggtaaaaaaaacttttgcggccgcgaattcc

SEQ ID NO: 1140 - protein, 270 aa, Arabidopsis thaliana
  G563,bZIP domain coordinates 186-248
MASFKLMSSSNSDLSRRNSSSASSSPSIRSSHHLRPNPHADHSRISFAYGGGVNDYTFASDSKPFEMAIDVDRSIGDRNSVNNGKSVDDVWKEIVSGEQKTIMMKEEEPEDIMTLEDFLAKAEMDEGASDEIDVKIPTERLNNDGSYTFDFPMQRHSSFQMVEGSMGGGVTRGKRGRVMMEAMDKAAAQRQKRMIKNRESAARSRERKQAYQVELETLAAKLEEENEQLLKEIEESTKERYKKLMEVLIPVDEKPRPPSRPLSRSHSLEW

SEQ ID NO: 1141 - DNA, 1479 bp, Arabidopsis thaliana
  G567,family:bZIP
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 1142 - protein, 411 aa, Arabidopsis thaliana
  G567,bZIP domain coordinates 210-270
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 1143 - DNA, 1294 bp, Arabidopsis thaliana
  G568,family:bZIP
gaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttatacttgtattcttg

SEQ ID NO: 1144 - protein, 284 aa, Arabidopsis thaliana
  G568,bZIP domain coordinates 215-265
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQKMAAAIQQPKKNTLQRSSTAPF

SEQ ID NO: 1145 - DNA, 2290 bp, Arabidopsis thaliana
  G577,family:BZIPT2
aaaaacagactgagagagagagagagagagtgtgttgttggccatgggatgcacggcctccaagctcgacagtgaggatgctgtccgtcgctgcaaggagcggcgccgtcttatgaaggacgccgtctacgctcgtcaccatctcgccgccgctcactctgactactgccgctcccttcgtctcactggctctgccctctcctccttcgccgccggcgagcccctctccgtctccgagaatactcccgctgtttttctccgcccttcctccagtcaggacgcgccacgtgtcccttcttcccattccccagaaccccctcctccgcccatccgcagcaagcctaagcctactaggcctaggaggcttccacacattctctccgactcctctccttcttcctctcctgccaccagtttctatcccactgctcaccagaactctacttactctcgctctccatctcaagcttcctctgtctggaactgggagaatttctaccctccctctccccccgactccgagtacttcgaacgcaaagctcgccagaaccacaagcaccgtcctccttccgactacgacgccgaaactgaaagatccgaccacgattactgccactcacggagagatgccgccgaggaagttcactgcagcgagtggggcgacgaccacgaccgtttcactgccacctcttcgtccgacggagatggggaggtcgaaactcacgtttccagatccggtattgaagaagagcctgtgaaacaaccacatcaagacccaaatggcaaagagcactctgaccatgttaccacttcttccgactgctacaagaccaaattggtggtaaggcacaagaatttgaaggagatccttgacgccgttcaagactacttcgacaaggctgcctccgctggggaccaggtctccgccatgcttgagatcggccgggctgagctcgaccgcagcttcagcaagctgaggaagacggtgtatcattcaagcagtgtgttcagcaacttgagcgcaagctggacctcaaaacccccattggcagtcaaatacaagctcgatgcatctaccctgaatgatgaacaaggcggcctcaagagcctctgctccactctagaccgactcctcgcttgggaaaagaagctttatgaggatgtcaaggcaagagaaggagttaagattgagcacgagaagaagctgtctgcgctgcagagtcaggagtataagggaggtgatgaatccaagctagacaagactaaaacttccataaccagactgcaatcactcatcattgtttcttcagaagctgttttaaccacgtctaatgccattctccgcctccgggacactgaccttgtccctcagcttgttgaactctgccacggattaatgtacatgtggaagtcaatgcacgagtatcacgaaatccagaacaacatcgtgcaacaagtccgtggcctgatcaaccaaacagagagaggtgagtcaacatcagaggtacaccggcaggtgacgcgggacctagagtcagctgtgtccttgtggcattcgagcttctgtcgcatcattaaattccagagggagttcatatgctctctccacgcatggttcaagctgagcctggttcccctgagcaacggagacccaaagaaacagcggccagactcatttgccttgtgcgaggagtggaagcagagcctggaacgggtgcctgacacagtggcgtcagaagccataaagagctttgtaaacgtggtacatgtgatatcaataaagcaggcggaagaggtgaagatgaagaaacgcacggagagtgcaggaaaggagctggagaagaaagcatcctcactgaggagcatagagaggaagtactaccaggcatactcgacggttgggataggccctggaccggaggtgttggactcacgggacccgctatctgagaagaaatgtgagctggcggcatgtcagaggcaggtggaggatgaggtaatgaggcacgtgaaggctgtggaggtgacacgagctatgactctcaacaatctacaaaccggcctgcccaatgtattccaggccttgaccagcttctcatctctcttcactgaatctctccagactgtctgttctcgttcctactccatcaactgattatgtccaagtttctcatttatttttaagctctcattacgttggtatcatgtaaatttgaggattgattaaattgagtcttgtggttttgtgaggactcacaatctttctcatttaaaaaaaaaaaaaaaaaaa

SEQ ID NO: 1146 - protein, 703 aa, Arabidopsis thaliana
  G577,BZIPT2 domain coordinates 1-53,356-466
MGCTASKLDSEDAVRRCKERRRLMKDAVYARHHLAAAHSDYCRSLRLTGSALSSFAAGEPLSVSENTPAVFLRPSSSQDAPRVPSSHSPEPPPPPIRSKPKPTRPRRLPHILSDSSPSSSPATSFYPTAHQNSTYSRSPSQASSVWNWENFYPPSPPDSEYFERKARQNHKHRPPSDYDAETERSDHDYCHSRRDAAEEVHCSEWGDDHDRFTATSSSDGDGEVETHVSRSGIEEEPVKQPHQDPNGKEHSDHVTTSSDCYKTKLVVRHKNLKEILDAVQDYFDKAASAGDQVSAMLEIGRAELDRSFSKLRKTVYHSSSVFSNLSASWTSKPPLAVKYKLDASTLNDEQGGLKSLCSTLDRLLAWEKKLYEDVKAREGVKIEHEKKLSALQSQEYKGGDESKLDKTKTSITRLQSLIIVSSEAVLTTSNAILRLRDTDLVPQLVELCHGLMYMWKSMHEYHEIQNNIVQQVRGLINQTERGESTSEVHRQVTRDLESAVSLWHSSFCRIIKFQREFICSLHAWFKLSLVPLSNGDPKKQRPDSFALCEEWKQSLERVPDTVASEAIKSFVNVVHVISIKQAEEVKMKKRTESAGKELEKKASSLRSIERKYYQAYSTVGIGPGPEVLDSRDPLSEKKCELAACQRQVEDEVMRHVKAVEVTRAMTLNNLQTGLPNVFQALTSFSSLFTESLQTVCSRSYSIN

SEQ ID NO: 1147 - DNA, 1400 bp, Arabidopsis thaliana
  G579,family:bZIP
aaagcaagcaacagaataaattcttctccttttcttttttgttgcaactagtgaaagagaaagagacgatcgcttattttcttcttctcctacactctgcgtttttgctctctttttactccgcattgctcctccgttactatcttcgccggcgaaaatttgttttctttttccctggaggtaaattcgaatcatgtcaaggcctgctccgcttccacctcgttgcccgattccaaagaaactttctttgagtccagttgcagatacattctactcttcttcctcacccattgaatcatacattggtcaatacaagtcttctactcaagattccaggctcgaagatcaacctgcttggcttgatgagttgctctgtgacaaaactgatgggttgctcactagaggaggtcctctgcgccgctcagctagcgactcagttgtgcttttgggagacatttctgctactttttctggttttgatcaaagtgaggatgaagaaagtttgagttctgaagcttgtggggacttggagtctgcttgtgtatatggtcccaactcgccaagagcaaagaacaactctagcttctctaacaaccctattgcttctgccttttcggattatggttctcagacaccgcctcagaacttggatgatacggtgaaagggatcaaccgttcacctgttgctgaaaatgcgtgtggttcaatgggcataccaaatgcaaaaaggaacccgggacagcgttcaagggttcgtaagctccagtacattgctgaacttgagagaacagtaggcatgttgcagacggtggaagcagatttatcagtgagagtggcttcacttcttcagacacgagcaacactgtccctggagaatagccagttgaagcagcagatggcgatactaaagcaggacaagctcataagggaaggtgagtatcagttactgaagaaggaagctcagagattgaaatctggattgggatacttagggagcactaacaacagtaacaggctggtgaggtcatattctgctggttcaaatgtagctccaaggacagcttcgtcccacttggactggaatttgctagatctgaccaaactcaatctcaactaaagacaaaaccctccataagaataagtagcttaaggaattcaagagttaacagttctatgttcggaaaatgaacaaatctttgtcgatttgtataaatatgatttaggagtataaagtatcccactgtcttgggatgtagtcttttttagctaaaatgctctgatattggagacattttaagggttcctattttgtagctcattgagtaattgtggtggctttgactgagagtattcttctatttctggtgttctaaaaagctattaatttgatgaacgttggg

SEQ ID NO: 1148 - protein, 307 aa, Arabidopsis thaliana
  G579,bZIP domain coordinates 167-227
MSRPAPLPPRCPIPKKLSLSPVADTFYSSSSPIESYIGQYKSSTQDSRLEDQPAWLDELLCDKTDGLLTRGGPLRRSASDSVVLLGDISATFSGFDQSEDEESLSSEACGDLESACVYGPNSPRAKNNSSFSNNPIASAFSDYGSQTPPQNLDDTVKGINRSPVAENACGSMGIPNAKRNPGQRSRVRKLQYIAELERTVGMLQTVEADLSVRVASLLQTRATLSLENSQLKQQMAILKQDKLIREGEYQLLKKEAQRLKSGLGYLGSTNNSNRLVRSYSAGSNVAPRTASSHLDWNLLDLTKLNLN

SEQ ID NO: 1149 - DNA, 1054 bp, Arabidopsis thaliana
  G580,family:bZIP
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 1150 - protein, 234 aa, Arabidopsis thaliana
  G580,bZIP domain coordinates 162-218
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 1151 - DNA, 1757 bp, Arabidopsis thaliana
  G588,family:HLH/MYC
atctgaagtgaaccaagctcaggttttgtcttctctttgatcattcctttctcagcaatataaattagagttatatcctttataaaggattttgctttttcaccaacaaaccctaaattcggtgtctcagcaagaatcacgtgattctcgttcctcttcctcacgaaacccatcatcttctatctcatttgagaaatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggctgcagatttgcctagctgcttgagttattatagggttaggtctttcttagctaggtcagctggttttcagactgtgttgtctgtaccagtgaattctggagttgtggagcttggttctttaagacatattccagaagataagagtgtgattgagatggtgaaatcagtgtttggtgggtctgactttgttcaggctaaagaagctcctaaaatctttggtcgacagctgagtcttggtggagcaaaacctcggtctatgagtattaatttctccccgaagaccgaggatgacacgggtttctcattggaatcgtatgaggtgcaagcgatcggaggctctaatcaagtgtatggttatgagcaagggaaagatgagacattgtatctaactgacgagcaaaagccgaggaagagagggagaaaaccagcaaatggaagagaagaggctctaaaccatgtggaagcggaacggcagaggagggagaagctgaaccagagattctacgctttgagagcggtggtgcctaacatctccaagatggacaaggcttcgctccttgcagacgcaatcacttacatcacggatatgcagaagaaaatcagggtgtatgaaacagagaagcagataatgaagaggagggagagtaatcagataactccagcagaggttgattatcaacagaggcatgatgatgcagttgtaaggctaagctgtccgttggaaactcatccagtttcaaaggtgatacaaacgttgagggagaatgaagttatgcctcatgattccaacgtggccatcacagaggagggtgtggttcacacattcactctccggcctcagggtggctgcaccgctgagcagttgaaggacaagctccttgcctctctatcacagtaactatcacagcagtaactgctatgtaataagtgtaaccgtgttggaggttgtatcaatgtactattgcaagccaaccaaaaaaaactccagcttagtaggatcgtgtaattttccttatatgtaatgttgagatttgtcttttacatataaagatttga

SEQ ID NO: 1152 - protein, 467 aa, Arabidopsis thaliana
  G588,HLH/MYC domain coordinates 313-370
MGQKFWENQEDRAMVESTIGSEACDFFISTASASNTALSKLVSPPSDSNLQQGLRHVVEGSDWDYALFWLASNVNSSDGCVLIWGDGHCRVKKGASGEDYSQQDEIKRRVLRKLHLSFVGSDEDHRLVKSGALTDLDMFYLASLYFSFRCDTNKYGPAGTYVSGKPLWAADLPSCLSYYRVRSFLARSAGFQTVLSVPVNSGVVELGSLRHIPEDKSVIEMVKSVFGGSDFVQAKEAPKIFGRQLSLGGAKPRSMSINFSPKTEDDTGFSLESYEVQAIGGSNQVYGYEQGKDETLYLTDEQKPRKRGRKPANGREEALNHVEAERQRREKLNQRFYALRAVVPNISKMDKASLLADAITYITDMQKKIRVYETEKQIMKRRESNQITPAEVDYQQRHDDAVVRLSCPLETHPVSKVIQTLRENEVMPHDSNVAITEEGVVHTFTLRPQGGCTAEQLKDKLLASLSQ

SEQ ID NO: 1153 - DNA, 1240 bp, Arabidopsis thaliana
  G591,family:HLH/MYC
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 1154 - protein, 310 aa, Arabidopsis thaliana
  G591,HLH/MYC domain coordinates 149-206
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 1155 - DNA, 868 bp, Arabidopsis thaliana
  G595,family:HLH/MYC
cggacgcgtgggcggacgcgtggggtttgagcgcatcgcaaactcgaaggcgcgactgtgagagagaagaatggcgtcgtcatcatcgagaggagagatggagaagatgggaatcgatcagctaaaagctttgaaggagcaagcagatctggaagtgaatcttcttcaagatagtctcaacaacatccgtacagctaccgttcgtctcgatgccgccgccgcagctctcaacgatctctctcttcgacctcaaggtaagaagatgcttgtaccactgactgcttctctatacgtgcctgggacacttgatgaagctgataaggttttagttgatattggcactggttacttcattgagaaaacaatggatgatggaaaagattattgtcagaggaagatcaacttgctcaaatccaactttgatcaactttttgaggtcgcagcgaaaaagaaaagcgtggcagatgaagctggaatggtcttgcaggccaaagttaaacagttaacagctgcaaccacgtcgtgaaaattattccttctctagtgctttttgctattgagactattttgagattgcaaatgattttgtctgatcagttatgttttgactcttttgatctcaatcggcttgtgtttagtgtgctagaagaatttgtgctgtaattttaagtaatcagtagtgactatgagaaagaaaagacgtgttaactagttatttctcataaaacgtgagaaaagagacaaaagcgatgatgttattggaggcaaaaacgatgatgttattgttgggggtagaaagagacaactgaatcaatgaactttaaatacaacttgttttgttgttttaagaaaagggatctttccgcaa

SEQ ID NO: 1156 - protein, 151 aa, Arabidopsis thaliana
  G595,HLH/MYC domain coordinates NA
MASSSSRGEMEKMGIDQLKALKEQADLEVNLLQDSLNNIRTATVRLDAAAAALNDLSLRPQGKKMLVPLTASLYVPGTLDEADKVLVDIGTGYFIEKTMDDGKDYCQRKINLLKSNFDQLFEVAAKKKSVADEAGMVLQAKVKQLTAATTS

SEQ ID NO: 1157 - DNA, 1394 bp, Arabidopsis thaliana
  G596,family:AT-hook
taatttctctacttcagatttttttctccttagattaatttaattgagttattgtacatccctcaagctaagattctggttttgtgagttgagtggatgagaagaggagagattaactaaattagggtttcaattgtttactttttgtttgctttttatatcaagtaatggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgctcgatctattaggtttgagagggggtttgtgttttgcgttgactagcagattataaaattgttgattttcgagtttttattttcatgtgttggtgataaa

SEQ ID NO: 1158 - protein, 317 aa, Arabidopsis thaliana
  G596,AT-hook domain coordinates 89-97,98-244
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 1159 - DNA, 1226 bp, Arabidopsis thaliana
  G598,family:DBP
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 1160 - protein, 263 aa, Arabidopsis thaliana
  G598,DBP domain coordinates 205-263
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 1161 - DNA, 1857 bp, Arabidopsis thaliana
  G599,family:DBP
tcgacagaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagtgtgagtttttttttaacttatgtggtcaaatttcattagtaggggttcttttaaggtaatggttttttgggttgggtataggataaaatggacctaccagtcaaggtgaggaagcatttgggtaaacaaaacttagtgggggtgatctgtaatatctatgttcttagtttttttttggttgttggtggtctttttgtataaaaaaacaaagttgaagtaatagatatatagtatgttttaattttaaa

SEQ ID NO: 1162 - protein, 475 aa, Arabidopsis thaliana
  G599,DBP domain coordinates 187-219,264-300
MEKLMVPTWRPDPVYRPPETPLEPMEFLARSWSVSALEVSKALTPPNPQILLSKTEEEEEEEPISSVVDGDGDTEDTGLVTGNPFSFACSETSQMVMDRILSHSQEVSPRTSGRLSHSSGPLNGSLTDSPPVSPPESDDIKQFCRANKNSLNSVNSQFRSTAATPGPITATATQSKTVGRWLKDRREKKKEETRAHNAQIHAAVSVAGVAAAVAAIAAATAASSSCGKDEQMAKTDMAVASAATLVAAQCVEAAEVMGAEREYLASVVSSAVNVRSAGDIMTLTAGAATALRGVQTLKARAMKEVWNIASVIPMDKGLTSTGGSSNNVNGSNGSSSSSHSGELVQQENFLGTCSREWLARGCELLKRTRKGDLHWKIVSVYINKMNQVMLKMKSRHVGGTFTKKKKNIVLDVIKNVPAWPGRHLLEGGDDLRYFGLKTVMRGDVEFEVKSQREYEMWTQGVSRLLVLAAERKFRM

SEQ ID NO: 1163 - DNA, 1519 bp, Arabidopsis thaliana
  G615,family:TEO
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 1164 - protein, 351 aa, Arabidopsis thaliana
  G615,TEO domain coordinates 88-147
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 1165 - DNA, 3001 bp, Arabidopsis thaliana
  G619,family:ARF
atttttttccaatctgcaaattttagtctatgtctgttccttgtgctccctcttctcagtacctgcaaatggaggaagaagaatccttctctgaaacccttgttctcatttgattcctccttcctctctcttcttctctctctgtctctgattcgttattccacacttatgactcatctttcccgtcaatagctaagtttgcctcttctttgtgaaatttagctgaaaaaggagaggaattccgaattctgtcacttcaaagctcgaattttgcaaactttcctttgatgggttttacttgttttgttgtaatctgattaaaaatagaaactttttgttttcttcttgtctccttttgctcttaaaagagaagctttttcaatggaatttgacttgaatactgagattgcggaggtggaagaggaggagaatgatgatgtaggagtaggagtaggaggaggaacaagaattgacaagggtaggcttggaatttcaccatcttcttcttcttcatgctcttccggatcatcatcgtcatcatcttctacaggctctgcatcttccatttactctgagctttggcatgcttgtgctggtcctctcacttgtcttcccaagaaaggcaatgtagttgtctatttccctcaaggtcatttggagcaagatgctatggtttcatattcgtctcctcttgaaatccccaaatttgaccttaatccccaaatcgtctgcagggtggttaatgtccagttgcttgctaataaggacaccgatgaggtctacactcaagtcactctgcttccacttcaagagttttcgatgctaaatggggaggggaaagaggtcaaggagttaggaggggaggaagagaggaacggaagctcatccgtcaagcggacacctcatatgttctgtaaaaccttaacagcgtctgacacaagcacacatggaggcttctctgtacctagaagagccgctgaagattgttttgctcctcttgactacaaacaacagaggccatctcaagagctcattgcaaaggacctccatggagtagagtggaagtttcgccatatctatagaggtcaaccaaggaggcatctactcaccactggttggagtatctttgtcagtcaaaagaatctcgtctctggtgatgcggttctctttctgagagacgaaggaggagagctgagattaggaatcagaagagcagcacggccaagaaatggacttcctgactcaatcattgagaagaattcatgttcaaacattctgtctcttgtggctaatgctgtatctacaaaaagcatgtttcatgtgttctacagtccacgagcgacgcatgcagagtttgtgattccttatgagaagtatatcacaagcatcaggagtcctgtttgcataggcacaagatttagaatgcgatttgaaatggacgattctcctgagagaagatgcgctggtgtagtgactggagtctgtgacttggacccgtataggtggccaaactctaaatggaggtgcttgttggtgcgatgggatgagtcttttgtgagtgatcatcaagaaagagtttcaccttgggagattgatccctcggtttctctcccacacttgagcattcagtcatctccaaggcctaaaaggccatgggcaggtttactggatactaccccacccggaaaccccataacaaaaaggggtggttttttggactttgaggagtcggttagaccctctaaggtcttgcaaggtcaagaaaatataggttctgcatcaccctcacaggggtttgatgttatgaaccgccggatactggattttgcgatgcagtctcatgcaaatccagtccttgtgtcgagtagagtcaaggatcgatttggtgagtttgtagatgctactggcgtgaacccagcttgttcaggtgttatggacctggataggtttccaagggtcttgcaaggtcaagaaatttgctcgcttaaatcattcccgcaatttgctggtttcagtccagctgctgctcctaatccctttgcttaccaagccaacaagtcaagttactatccgctagctttgcatgggattaggagcactcatgttccgtatcagaatccatacaatgcgggaaaccaatcctcgggtcccccttcacgtgcaataaactttggtgaagagactagaaagtttgatgcacaaaatgaaggtggcctaccaaataatgttacagctgatttgccattcaagattgatatgatgggaaaacagaaaggcagtgagttgaatatgaatgcttcatcaggatgtaaacttttcggattctccttaccagtggagacacctgcatctaagccgcaaagctcgagcaaaagaatctgtacaaaggttcacaagcaaggaagccaagtggggagagctattgatttgtcgcgacttaacgggtatgatgatctccttatggagcttgaacggctgttcaacatggaagggcttctcagggatcctgaaaaaggatggaggatcttatatactgatagtgagaacgatatgatggtcgttggcgatgatccatggcatgatttctgcaatgtggtgtggaagatacacttatacacgaaagaggaagtggagaatgcgaatgacgataacaagagttgtttagagcaagctgctctcatgatggaagcatcaaagtcatcttctgtgagccagcctgattcttctcctacaatcactagggtttgatacccataaagaagcttatttcctatgttttaaagtgtgttttgctcacaaaagaacttcaactttatctttgtctttgaatccatttatgtgtttgtttgtgtttcttctggtctccatggatgtctcatgtgtaccgttttactcgagagatatgtgagtttatgggatgtgtaaagcatgccattggattttaaggttttcaaaattacaatatatatattagttttgaagttaaaaaaaaaaaaaaaaa

SEQ ID NO: 1166 - protein, 788 aa, Arabidopsis thaliana
  G619,ARF domain coordinates 64-406
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 1167 - DNA, 1500 bp, Arabidopsis thaliana
  G625,family:AP2
aatcgaccattcacaacgatgacattcaaacactcttcagtttcccttccttcttgattcgtcctctccactatttttctcaatttctttaatctctctctttctctctctacttcctcttcctcttcttcttcttcttcttcttcatctatggaccctttagcttcccaacatcaacacaaccatctggaagataataaccaaaccctaacccataataatcctcaatccgattccaccaccgactcatcaacttcctccgctcaacgcaaacgcaaaggcaaaggtggtccggacaactccaagttccgttaccgtggcgttcgacaaagaagctggggcaaatgggtcgccgagatccgagagccacgtaagcgcactcgcaagtggcttggtactttcgcaaccgccgaagacgccgcacgtgcctacgaccgggctgccgtttacctatacgggtcacgtgctcagctcaacttaaccccttcgtctccttcctccgtctcttcctcttcctcctccgtctccgccgcttcttctccttccacctcctcttcctccactcaaaccctaagacctctcctccctcgccccgccgccgccaccgtaggaggaggagccaactttggtccgtacggtatcccttttaacaacaacatcttccttaatggtgggacctctatgttatgccctagttatggttttttccctcaacaacaacaacaacaaaatcagatggtccagatgggacaattccaacaccaacagtatcagaatcttcattctaatactaacaataacaagatttctgacatcgagctcactgatgttccggtaactaattcgacttcgtttcatcatgaggtggcgttagggcaggaacaaggaggaagtgggtgtaataataatagttcgatggaggatttgaactctctagctggttcggtgggttcgagtctatcaataactcatccaccgccgttggttgatccggtatgttctatgggtctggatccgggttatatggttggagatggatcttcgaccatttggccttttggaggagaagaagaatatagtcataattgggggagtatttgggattttattgatcccatcttgggggaattctattaatttgtttttgtggaagatcatattatatacgatgagcatccctaaggtcggtcaagagcattggagattcattgttgagaggaatcaaagagattgcattctatgaggagctctgcatgcaaaattttggaggatttttttactacctatagagataaataagagggtatttttattatttttttgaagatttttattttcaaggaattcgtaaaagagattacggttccaataaagtatgtatatgtggaagagaatcggaggagatggtggaaagttgtatgggaattttattggttcaacacttccttcacagtgtgcctaccttaatatataattattgataggatatgataatttctg

SEQ ID NO: 1168 - protein, 328 aa, Arabidopsis thaliana
  G625,AP2 domain coordinates 52-119
MDPLASQHQHNHLEDNNQTLTHNNPQSDSTTDSSTSSAQRKRKGKGGPDNSKFRYRGVRQRSWGKWVAEIREPRKRTRKWLGTFATAEDAARAYDRAAVYLYGSRAQLNLTPSSPSSVSSSSSSVSAASSPSTSSSSTQTLRPLLPRPAAATVGGGANFGPYGIPFNNNIFLNGGTSMLCPSYGFFPQQQQQQNQMVQMGQFQHQQYQNLHSNTNNNKISDIELTDVPVTNSTSFHHEVALGQEQGGSGCNNNSSMEDLNSLAGSVGSSLSITHPPPLVDPVCSMGLDPGYMVGDGSSTIWPFGGEEEYSHNWGSIWDFIDPILGEFY

SEQ ID NO: 1169 - DNA, 1661 bp, Arabidopsis thaliana
  G631,family:bZIP
cttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagagaaaagtacagactttacaaacagaggccacatctctctcagcccagttgactctcttacagagagatacaaatggcctgggtgttgaaaacaatgagcttaaactgcgagtacaaactatggagcaacaggtccacctacaggatgctttaaatgatgcactaaaggaggaagtccagcatcttaaggtattgacggggcaaggtccatcaaatggtacatcaatgaactacggttcttttggatcaaaccagcaattctatcccaataatcagtcgatgcacactatcttagccgcacaacagttacagcagctccagatccagtcacagaaacagcaacaacaacaacagcaacaccagcaacaacaacagcagcagcagcagcaatttcactttcaacagcagcaactgtaccagcttcagcagcagcaacggcttcaacaacaggaacaacaaagcggggcttcagagctaagaagacccatgccttctcctggtcagaaagagagtgtgacatcgcctgatcgtgaaactcccttgacaaaagactgagtctagactgtgctaatgtccaatttagtaagttactcttggaaaatcttctttttcatcgcaggctcatggatttgggatttactgcattatagagttaaaaacaagacagcttagaagttgcggatttagaagttgttagtgaagcttttgttctcgtctgttggtagtttacaatcttctctttgtatgatcctaag

SEQ ID NO: 1170 - protein, 423 aa, Arabidopsis thaliana
  G631,bZIP domain coordinates 212-282
MDKEKSPAPPPSGGLPPPSGRYSAFSPNGSSFAMKAESSFPPLTPSGSNSSDANRFSHDISRMPDNPPKNLGHRRAHSEILTLPDDLSFDSDLGVVGAADGPSFSDDTDEDLLYMYLDMEKFNSSATSTSQMGEPSEPTWRNELASTSNLQSTPGSSSERPRIRHQHSQSMDGSTTIKPEMLMSGNEDVSGVDSKKAISAAKLSELALIDPKRAKRIWANRQSAARSKERKMRYIAELERKVQTLQTEATSLSAQLTLLQRDTNGLGVENNELKLRVQTMEQQVHLQDALNDALKEEVQHLKVLTGQGPSNGTSMNYGSFGSNQQFYPNNQSMHTILAAQQLQQLQIQSQKQQQQQQQHQQQQQQQQQQFHFQQQQLYQLQQQQRLQQQEQQSGASELRRPMPSPGQKESVTSPDRETPLTKD

SEQ ID NO: 1171 - DNA, 798 bp, Arabidopsis thaliana
  G634,family:TH
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 1172 - protein, 265 aa, Arabidopsis thaliana
  G634,TH domain coordinates 62-147,189-245
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 1173 - DNA, 993 bp, Arabidopsis thaliana
  G635,family:TH
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 1174 - protein, 330 aa, Arabidopsis thaliana
  G635,TH domain coordinates 239-323
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 1175 - DNA, 1399 bp, Arabidopsis thaliana
  G639,family:TH
ttttttttaccttttcccgaaatggaacttctcgccggcgactgtcggaaacgagtcggcgacgactttgaggaagatattaacccattcgatggttcggacggtggttgcgggtggatgtacggtacccgtcaaatgggttctaacggaaacgacgacgctttggctacgctcgcagacttggcttcgcctcctcagaaattgaaacctataaggtgtggcgttaagcttccgtcgtcgtcggaggatcgacatcctcttgatattctcgccggaaccctagataggctgccggagatgggttttggctgcttcgaagctcctttgggatcgaagattgctgacgtggaggaaagtggtcaattgactcgtgggttttcaaaggaagaggatgattctcttcctcctcttcaaatggagtttcaagctcgaaatcgcatctcttgggatggtctctctctcagctcctctgttgatagcagcgatagtgactcatctccagacgttcgcaagaccgtcacgggtaaaagaaagcgggaaacaagggtaaagctggagcatttcttggagaagcttgtggggagtatgatgaagcggcaggagaagatgcataatcagttgattaatgtgatggagaagatggaagtggagagaatacgccgtgaggaagcttggaggcaacaggaaaccgagaggatgacacagaatgaagaagcacggaagcaagagatggcacgcaacttgtctctcatctctttcatcagaagtgttactggtgacgagatcgagatccctaaacagtgtgaattcccgcaaccactccagcagattcttccggaacaatgtaaagacgagaaatgtgaatccgctcagagagaaagagagataaagtttaggtactcaagcggcagtggcagcagtggtagaaggtggccgcaagaggaagtgcaggcattgataagttcgagaagcgatgtggaagagaagacggggatcaacaagggagcgatttgggatgagatatcagcaagaatgaaagaaagagggtacgaaagatctgcgaaaaagtgtaaggagaagtgggagaacatgaacaagtactataggagagtgacggaaggtgggcagaaacagcctgagcacagcaagactcgctcatactttgagaaacttggaaatttttacaagaccatttcctcgggagagagggaaaaatgagtgaaagattttaaatttaggtgtttttggcacgcaaaacgggagaacttgtagatgattacctcgagtttaatttttatatctttggtgtagtttataatttaaaactctacggctctgtatttgtagaaggttcgaataaaaaagacaaatacgttggggtgaaaaaaaaaaaaaaaaa

SEQ ID NO: 1176 - protein, 398 aa, Arabidopsis thaliana
  G639,TH domain coordinates 304-389
MELLAGDCRKRVGDDFEEDINPFDGSDGGCGWMYGTRQMGSNGNDDALATLADLASPPQKLKPIRCGVKLPSSSEDRHPLDILAGTLDRLPEMGFGCFEAPLGSKIADVEESGQLTRGFSKEEDDSLPPLQMEFQARNRISWDGLSLSSSVDSSDSDSSPDVRKTVTGKRKRETRVKLEHFLEKLVGSMMKRQEKMHNQLINVMEKMEVERIRREEAWRQQETERMTQNEEARKQEMARNLSLISFIRSVTGDEIEIPKQCEFPQPLQQILPEQCKDEKCESAQREREIKFRYSSGSGSSGRRWPQEEVQALISSRSDVEEKTGINKGAIWDEISARMKERGYERSAKKCKEKWENMNKYYRRVTEGGQKQPEHSKTRSYFEKLGNFYKTISSGEREK

SEQ ID NO: 1177 - DNA, 1083 bp, Arabidopsis thaliana
  G641,family:TH
tcttgattctttcatatggatggacatcagcatcatcaccttcaccagcttcaatatctcaacaagcatcatcttcatactcaatcgcaaacgccggaaatagcctctccggtagctgttggggataggtttccacagtggagcgtcgaagagacaaaagagttgatagggataagaggagagctagatcaaactttcatggagacaaaacggaacaagcttctttgggaagttatctctaacaagatgagagacaaaagctttcctcgtagccctgaacagtgcaagtgcaagtggaagaacctcgtcactcgttttaagggatgtgagacaatggaggcagagacagcgagacaacagttccctttttatgatgatatgcaaaatatatttaccactagaatgcagagaatgctatgggctgaatccgagggaggaggagggggaacaagcggggcagcgagaaagagagagtattcttcagatgaggaagaagagaatgtgaatgaagagctagtagatgtcagcaacgacccaaaaattctaaatccgaaaaagaacattgcaaagaagcgaaaaggcggtagtaatagtagtaatagcaataatggtgtaagagaagtgttggaagagtttatgagacatcaagtgagaatggagagcgagtggagagaaggatgggaggctagggagaaggaaagagcagagaaagaagaagaatggagaaggaagatggaggagcttgagaaggagaggttggcaatggagcggatgtggcgggatagagaggagcaacggcggtcgagggaggagatgagagcagagaagagggattcacttatcaatgcattgcttgctaagcttactagagatggttccctctaatcttttgtcagctttgcttaacctaaattaacttgttcttatatgcttgtttggggtgtagtgtaggtacaattatttggtgggggaagataatatctacggcaaatctcaacactcatatattgattgatatgatgacatatttgagttttagtgaggctttagtaatttatcatccccacatttttcttcctagtt

SEQ ID NO: 1178 - protein, 289 aa, Arabidopsis thaliana
  G641,TH domain coordinates 23-102
MDGHQHHHLHQLQYLNKHHLHTQSQTPEIASPVAVGDRFPQWSVEETKELIGIRGELDQTFMETKRNKLLWEVISNKMRDKSFPRSPEQCKCKWKNLVTRFKGCETMEAETARQQFPFYDDMQNIFTTRMQRMLWAESEGGGGGTSGAARKREYSSDEEEENVNEELVDVSNDPKILNPKKNIAKKRKGGSNSSNSNNGVREVLEEFMRHQVRMESEWREGWEAREKERAEKEEEWRRKMEELEKERLAMERMWRDREEQRRSREEMRAEKRDSLINALLAKLTRDGSL

SEQ ID NO: 1179 - DNA, 1677 bp, Arabidopsis thaliana
  G645,family:SCR
atgcccttaccctttgaagagtttcaagggaaggggatttcttgtttctcttctttctcgtcttccttcccccaaccaccgtcgtctccgcttttgagccaccgcaaagcaagaggcggcgaagaagaagaggaagaagttcccgcggcggagcctacctctgttctggactccctcataagcccaacctcttcctccacggtgtcttcctctcacggcggaaacagcgccgtcggaggcggcggcgacgccaccaccgatgagcaatgcggagccattgggttgggtgattgggaggagcaagttcctcatgaccacgaacagagcattctcggactcatcatgggagattccacagatccctctcttgaactcaacagcattctccaaacatctcccaccttccacgactctgactactcatcacccggtttcggagtcgtcgacaccggcttcggtttagaccaccactctgttccgccgtcacatgtttccggtcttctgatcaaccaaagtcaaacccactacacacagaatcctgcggctatcttctacggccaccaccaccatacacctccgccggcaaagcggctcaaccctggtcccgtggggataacagagcagctggttaaggcagcagaggtcatagagagcgacacgtgtctagctcaggggatattggcgcggctcaatcaacagctctcttctcccgtcgggaagccattagaaagagcagctttttacttcaaagaagctctcaataatctccttcacaacgtctcccaaaccctaaacccttattccctcatcttcaagatcgctgcttacaaatccttctcagagatctctcccgttcttcagttcgccaactttacctccaaccaagccctcttagagtccttccatggcttccaccgtctccacatcatcgacttcgatatcggctacggtggccaatgggcttccctcatgcaagagcttgttctccgcgacaacgccgctcctctctccctcaagatcaccgttttcgcttctccggcgaaccacgaccagctcgaacttggcttcactcaagacaacctcaagcacttcgcctctgagatcaacatctcccttgacatccaagttttgagcttagacctcctcggctccatctcgtggcctaactcgtcggagaaagaagctgtcgccgttaacatctccgccgcgtccttctcgcacctccctttggtcctccgtttcgtgaagcatctatctccgacgatcatcgtctgctccgacagaggatgcgagaggacggatctgcccttctctcaacagctcgcccactcgctgcactcacacaccgctctcttcgaatccctcgacgccgtcaacgccaacctcgacgcaatgcagaagatcgagaggtttcttatacagccggagatagagaagctggtgttggatcgtagccgtccgatagaaaggccgatgatgacgtggcaagcgatgtttctacagatgggtttctcaccggtgacgcacagtaacttcacggagtctcaagccgagtgtttagtccaacggacgccagtgagaggctttcacgtcgagaagaaacataactcacttctcctatgttggcaaaggacagaactcgtcggagtttcagcatggagatgtcgctcctcctga

SEQ ID NO: 1180 - protein, 558 aa, Arabidopsis thaliana
  G645,SCR domain coordinates 276-341,392-479,480-553
MPLPFEEFQGKGISCFSSFSSSFPQPPSSPLLSHRKARGGEEEEEEVPAAEPTSVLDSLISPTSSSTVSSSHGGNSAVGGGGDATTDEQCGAIGLGDWEEQVPHDHEQSILGLIMGDSTDPSLELNSILQTSPTFHDSDYSSPGFGVVDTGFGLDHHSVPPSHVSGLLINQSQTHYTQNPAAIFYGHHHHTPPPAKRLNPGPVGITEQLVKAAEVIESDTCLAQGILARLNQQLSSPVGKPLERAAFYFKEALNNLLHNVSQTLNPYSLIFKIAAYKSFSEISPVLQFANFTSNQALLESFHGFHRLHIIDFDIGYGGQWASLMQELVLRDNAAPLSLKITVFASPANHDQLELGFTQDNLKHFASEINISLDIQVLSLDLLGSISWPNSSEKEAVAVNISAASFSHLPLVLRFVKHLSPTIIVCSDRGCERTDLPFSQQLAHSLHSHTALFESLDAVNANLDAMQKIERFLIQPEIEKLVLDRSRPIERPMMTWQAMFLQMGFSPVTHSNFTESQAECLVQRTPVRGFHVEKKHNSLLLCWQRTELVGVSAWRCRSS

SEQ ID NO: 1181 - DNA, 855 bp, Arabidopsis thaliana
  G649,family:RING/C3H2C3
atgaactccaacgaccaggatccgattccgttcagacccgaagacaacaacttctccggttccaaaacctacgccatgagcggcaaaatcatgctaagtgcaatagtaatcctcttcttcgtcgtcattttaatggtcttcctccatctttacgctcgttggtatctcctccgtgctcgtagacgtcatctccgtcgtcgtagccgtaaccgtcgcgctacgatggttttcttcaccgctgatcctttcaccgccgcaacttccgtcgtcgcttcacgtggacttgatccaaacgttattaaatctcttcctgttttcactttctccgacgagactcataaagatccgatcgaatgcgccgtttgtttatcggaattcgaagagagcgagacgggtcgggttttgcccaattgtcaacatacttttcatgttgattgtattgatatgtggtttcattctcattccacttgtcctctttgtcgatctctcgttgagtctctcgccgggattgaatcaacggaaccgagttctagctctggattgacggatgaaccacatggatctggatcttctcagatgctgagggaagattccgggagaaaaccggcggcgattgaggttccgaggaggacttttagcgagtttgaagatgagttgactcggagagactcgccggcgagtcagtcgtttaggtctccgatgagtcggatgttatctttcactcggatgttgagtagagatagaagaagcgcttcgtctcctatcgccggagctccgccgctatcgccgacgttaagctgccggatacagatgaccgagtcagatatcgaacggggaggagaagagggtaggtga

SEQ ID NO: 1182 - protein, 284 aa, Arabidopsis thaliana
  G649,RING/C3H2C3 domain coordinates NA
MNSNDQDPIPFRPEDNNFSGSKTYAMSGKIMLSAIVILFFVVILMVFLHLYARWYLLRARRRHLRRRSRNRRATMVFFTADPFTAATSVVASRGLDPNVIKSLPVFTFSDETHKDPIECAVCLSEFEESETGRVLPNCQHTFHVDCIDMWFHSHSTCPLCRSLVESLAGIESTEPSSSSGLTDEPHGSGSSQMLREDSGRKPAAIEVPRRTFSEFEDELTRRDSPASQSFRSPMSRMLSFTRMLSRDRRSASSPIAGAPPLSPTLSCRIQMTESDIERGGEEGR

SEQ ID NO: 1183 - DNA, 928 bp, Arabidopsis thaliana
  G653,family:Z-LIM
tcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgtgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgaaaaaaaaaaaaaaaaa

SEQ ID NO: 1184 - protein, 200 aa, Arabidopsis thaliana
  G653,Z-LIM domain coordinates 10-61,109-160
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 1185 - DNA, 1314 bp, Arabidopsis thaliana
  G655,family:MYB-(R1)R2R3
atgacagagtctattgatttaaatcgatcagagtccgagtctgataacaacaccgacgacgttactcctatttttgcaattgatgactcttcaaaaggaagagtgagtggtcctactagaagatcaactaaaggaggatggacagccgaagaggaccaaattttgacgaatgttgtgaagaagtaccaagggaggaactggaaaaggattgctgaatgccttcctgggtcggaagagaataggaggaatgatgtccaatgtcagcaccgttggcttaaggttcttgatccaagcctccaaaaaggagcttggaaaaaagaggaagatgaactcttaagtgagttggttaaagattatatggagaatgataggcctccatggtcaaaaatttcaaaggaactccctggtcgcatcggcaagcaatgccgcgaaaggtggcataatcatttgaatccgactattataaaatctccatggactagagaagaggaattaattctcgttcaagcacaaagaggaaacggcaacaaatgggcagagattgccaagctattgcctggaaggacggagaataatattaagaaccattggaattgttcagttaagaaaaggctagagcagtttcctagtaacctcttctctggtgtggtctatggttctaaacctagttctggttttgaatacaactttttcaatcaaagaaacacgatggtcgagagttgcataacatcacaaatcaaggaagctgcaaagagtcctcaaagggatttcttggatttaactttaggactgaattggaggagcatttcttcatccacaagctctcttagaggagaagaatcagtctcatcatcagtagactcagtttgtgcaagactcaatgcgtgtttagaaactccacagaacagcaacaacgatactgtgtgcgtaaaggaagtgagggagatgaaagagagacttagaatggctgcgaggactttcgacacaccctccattatctccaaaacaagctcaccagcttcaggtttgaaacggctcagacaaaaatacgatacaccgtttccaacagatgctcgaagtcacatgtcaagtgaggaagatcactcagtttcagcttctccttcatccaaatacagatttgtgaaacgcaacacctgctctggctcaaaacccttggagaggcgtttagattttgactttctattgtgggacgaacatggtcgaagaaacgggattgtcaatttctctgttaggattctgccccaaaaatctgatcttaaatccggtcttgtgcgtccgttttggttacgttag

SEQ ID NO: 1186 - protein, 437 aa, Arabidopsis thaliana
  G655,MYB-(R1)R2R3 domain coordinates 44-206
MTESIDLNRSESESDNNTDDVTPIFAIDDSSKGRVSGPTRRSTKGGWTAEEDQILTNVVKKYQGRNWKRIAECLPGSEENRRNDVQCQHRWLKVLDPSLQKGAWKKEEDELLSELVKDYMENDRPPWSKISKELPGRIGKQCRERWHNHLNPTIIKSPWTREEELILVQAQRGNGNKWAEIAKLLPGRTENNIKNHWNCSVKKRLEQFPSNLFSGVVYGSKPSSGFEYNFFNQRNTMVESCITSQIKEAAKSPQRDFLDLTLGLNWRSISSSTSSLRGEESVSSSVDSVCARLNACLETPQNSNNDTVCVKEVREMKERLRMAARTFDTPSIISKTSSPASGLKRLRQKYDTPFPTDARSHMSSEEDHSVSASPSSKYRFVKRNTCSGSKPLERRLDFDFLLWDEHGRRNGIVNFSVRILPQKSDLKSGLVRPFWLR

SEQ ID NO: 1187 - DNA, 774 bp, Arabidopsis thaliana
  G658,family:MYB-(R1)R2R3
atgggaagatcaccatgctgcgagaaagctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattag

SEQ ID NO: 1188 - protein, 257 aa, Arabidopsis thaliana
  G658,MYB-(R1)R2R3 domain coordinates 2-105
MGRSPCCEKAHMNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 1189 - DNA, 984 bp, Arabidopsis thaliana
  G659,family:MYB-(R1)R2R3
atggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattga

SEQ ID NO: 1190 - protein, 327 aa, Arabidopsis thaliana
  G659,MYB-(R1)R2R3 domain coordinates 16-116
MGKGRAPCCDKTKVKRGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKLHHNYGNKWSKIASQLPGRTDNEIKNVWHTHLKKRLAQSSGTADEPASPCSSDSVSRGKDDKSSHVEDSLNRETNHRNELSTSMSSGGSNQQDDPKIDELRFEYIEEAYSEFNDIIIQEVDKPDLLEIPFDSDPDIWSFLDTSNSFQQSTANENSSGSRATTEEESDEDEVKKWFKHLESELGLEEDDNQQQYKEEESSSSSLLKNYELMIH

SEQ ID NO: 1191 - DNA, 1033 bp, Arabidopsis thaliana
  G663,family:MYB-(R1)R2R3
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 1192 - protein, 249 aa, Arabidopsis thaliana
  G663,MYB-(R1)R2R3 domain coordinates 9-111
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 1193 - DNA, 1087 bp, Arabidopsis thaliana
  G664,family:MYB-(R1)R2R3
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 1194 - protein, 282 aa, Arabidopsis thaliana
  G664,MYB-(R1)R2R3 domain coordinates 14-116
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 1195 - DNA, 1158 bp, Arabidopsis thaliana
  G665,family:MYB-related
ccaacttggacaacatcatttaaattataaaaccctccaataaataaaacttggtttatccaatcatcttatttctctgtgctctccaccattttacataaaccccaaaatctctcttcatcatcatcattcatcaacatcatctctctttctctatctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtgaatctatataacacgttatgatcagtttcattagaataattcaaatgtttacatatataatatcttatcgatcctatctaatttgattttgatttaacgttagttactttgataatttcgtcgatattgtttttttggttttttcattgtgagattttttgtcttggaagttggatccatacatatttctgtaaaactttatatttaaggtatatatatctagcgctcataaaagtttcaatattccaaaaaaaaaaaaaaaaaa

SEQ ID NO: 1196 - protein, 233 aa, Arabidopsis thaliana
  G665,MYB-related domain coordinates 91-139
MGRRCSHCGNVGHNSRTCSSYQTRVVRLFGVHLDTTSSSPPPPPPPSILAAAIKKSFSMDCLPACSSSSSSFAGYLSDGLAHKTPDRKKGVPWTAEEHRTFLIGLEKLGKGDWRGISRNFVVTKSPTQVASHAQKYFLRQTTTLHHKRRRTSLFDMVSAGNVEENSTTKRICNDHIGSSSKVVWKQGLLNPRLGYPDPKVSVSGSGNSGGLDLELKLASIQSPESNIRPISVT

SEQ ID NO: 1197 - DNA, 1310 bp, Arabidopsis thaliana
  G666,family:MYB-(R1)R2R3
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 1198 - protein, 323 aa, Arabidopsis thaliana
  G666,MYB-(R1)R2R3 domain coordinates 14-116
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 1199 - DNA, 786 bp, Arabidopsis thaliana
  G674,family:MYB-(R1)R2R3
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 1200 - protein, 261 aa, Arabidopsis thaliana
  G674,MYB-(R1)R2R3 domain coordinates 20-120
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 1201 - DNA, 1292 bp, Arabidopsis thaliana
  G675,family:MYB-(R1)R2R3
taatcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgtttaaaaaaaaaaaaaaaaaaaa

SEQ ID NO: 1202 - protein, 365 aa, Arabidopsis thaliana
  G675,MYB-(R1)R2R3 domain coordinates 13-116
MGRSPCCDENGLKKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKLIQMGIDPVTHQPRTDLFASLPQLIALANLKDLIEQTSQFSSMQGEAAQLANLQYLQRMFNSSASLTNNNGNNFSPSSILDIDQHHAMNLLNSMVSWNKDQNPAFDPVLELEANDQNQDLFPLGFIIDQPTQPLQQQKYHLNNSPSELPSQGDPLLDHVPFSLQTPLNSEDHFIDNLVKHPTDHEHEHDDNPSSWVLPSLIDNNPKTVTSSLPHNNPADASSSSSYGGCEAASFYWPDICFDESLMNVIS

SEQ ID NO: 1203 - DNA, 1043 bp, Arabidopsis thaliana
  misc_feature (1010)..(1010): n is a, c, g, or t
  misc_feature (1024)..(1024): n is a, c, g, or t
  misc_feature (1036)..(1036): n is a, c, g, or t
  G679,family:MYB-related
ctaatctgtacggttcttatttcgaaagggtaaaaaccaaaagcgacgcaaagggcaaaatcggaaaaagtgttttatttatggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtggccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacactcggctttcacgatgatgccaagcttcagcgatggagatagcaatagcagcatcatcagagttgcttagagcttaaacccaaggggaatctacaagaacctggttctttctttgggtctctggtggtgggaggactaagnagtacctattaggngttaacagattngaaaaaa

SEQ ID NO: 1204 - protein, 209 aa, Arabidopsis thaliana
  G679,MYB-related domain coordinates 102-150
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVADKN

SEQ ID NO: 1205 - DNA, 341 bp, Arabidopsis thaliana
  G682,family:MYB-related
acatggataaccatcgcaggactaagcaacccaagaccaactccatcgttacttcttcttctgaaggaacagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatccc

SEQ ID NO: 1206 - protein, 77 aa, Arabidopsis thaliana
  G682,MYB-related domain coordinates 33-77
MDNHRRTKQPKTNSIVTSSSEGTEVSSLEWEVVNMSQEEEDLVSRMHKLVGDRWELIAGRIPGRTAGEIERFWVMKN

SEQ ID NO: 1207 - DNA, 1157 bp, Arabidopsis thaliana
  G699,family:HB
tcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcaatgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatgaaaaaaaaaaaaaaaaaaaaaaaaaaaaaaaaaaaaaaaaaaaaa

SEQ ID NO: 1208 - protein, 294 aa, Arabidopsis thaliana
  G699,HB domain coordinates 52-115
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 1209 - DNA, 859 bp, Arabidopsis thaliana
  G7,family:AP2
gtgactctaacgaagaaaccggcaatggccagtatcactacaatgccgaagaaataacaagaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgt

SEQ ID NO: 1210 - protein, 192 aa, Arabidopsis thaliana
  G7,AP2 domain coordinates 58-125
MVSMLTNVVSGETEPSASATWTMGHKREREEFSLPPQPLITGSAVTKECESSMSLERPKKYRGVRQRPWGKWAAEIRDPHKATRVWLGTFETAEAAARAYDAAALRFRGSKAKLNFPENVGTQTIQRNSHFLQNSMQPSLTYIDQCPTLLSYSRCMEQQQPLVGMLQPTEEENHFFEKPWTEYDQYNYSSFG

SEQ ID NO: 1211 - DNA, 2562 bp, Arabidopsis thaliana
  G707,family:HB
ctctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaacgaacctcattttgtgatgaatccgtttttgtgatg

SEQ ID NO: 1212 - protein, 808 aa, Arabidopsis thaliana
  G707,HB domain coordinates 109-169
MNFNGFLDDGAGASKLLSDAPYNNHFSFSAVDTMLGSAAIAPSQSLPFSSSGLSLGLQTNGEMSRNGEIMESNVSRKSSRGEDVESRSESDNAEAVSGDDLDTSDRPLKKKKRYHRHTPKQIQDLESVFKECAHPDEKQRLDLSRRLNLDPRQVKFWFQNRRTQMKTQIERHENALLRQENDKLRAENMSVREAMRNPMCGNCGGPAVIGEISMEEQHLRIENSRLKDELDRVCALTGKFLGRSNGSHHIPDSALVLGVGVGSGGCNVGGGFTLSSPLLPQASPRFEISNGTGSGLVATVNRQQPVSVSDFDQRSRYLDLALAAMDELVKMAQTREPLWVRSSDSGFEVLNQEEYDTSFSRCVGPKQDGFVSEASKEAGTVIINSLALVETLMDSERWAEMFPSMVSRTSTTEIISSGMGGRNGALHLMHAELQLLSPLVPVRQVSFLRFCKQHAEGVWAVVDVSIDSIREGSSSSCRRLPSGCLVQDMANGYSKVTWIEHTEYDENHIHRLYRPLLRCGLAFGAHRWMAALQRQCECLTILMSSTVSTSTNPSPINCNGRKSMLKLAKRMTDNFCGGVCASSLQKWSKLNVGNVDEDVRIMTRKSVNNPGEPPGIILNAATSVWMPVSPRRLFDFLGNERLRSEWDILSNGGPMKEMAHIAKGHDRSNSVSLLRASAINANQSSMLILQETSIDAAGAVVVYAPVDIPAMQAVMNGGDSAYVALLPSGFAILPNGQAGTQRCAAEERNSIGNGGCMEEGGSLLTVAFQILVNSLPTAKLTVESVETVNNLISCTVQKIKAALHCDST

SEQ ID NO: 1213 - DNA, 925 bp, Arabidopsis thaliana
  G714,family:CAAT
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 1214 - protein, 217 aa, Arabidopsis thaliana
  G714,CAAT domain coordinates 58-150
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 1215 - DNA, 705 bp, Arabidopsis thaliana
  G715,family:CAAT
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaa

SEQ ID NO: 1216 - protein, 234 aa, Arabidopsis thaliana
  G715,CAAT domain coordinates 53-149
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 1217 - DNA, 2209 bp, Arabidopsis thaliana
  G720,family:GARP
ctttgaatgtgactcaggatagagagagggcgagacagataaagagagcttgaggaaggatttaagcagatctgcaagaaacactctctcagtgtttactttttttccgtagaatcaaaccggcggcgacagtgacggcggcgaaaagcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgggaactgattcggatcctgagagttgttttttaattgttgtttttaattttttgttgtcataaaaacatttgtctctattggtattattaaagaagatcggacggtggagatagaggcaacgatgttagtctgaggaccacaagtggactctgcggctgtaagtagatctcggacacgggattttgacaagtcggaatctgacgtgtgtgcgtactcgcttttgtgggttgtcgagaatttaatagttgacactgttttaggtggatatgagatatgatgatgataataataaaaaggtacaactcaaagattccgtgatgaaaaaaaaaaaaaaa

SEQ ID NO: 1218 - protein, 535 aa, Arabidopsis thaliana
  G720,GARP domain coordinates 301-349
MVITANDLSKWENFPKGLKVLLLLNGCDSDGDGSSAAETRSELESMDYIVTTFTDETEALSAVVKNPESFHIAIVEVNMSAESESFKFLEAAKDVLPTIMISTDHCITTTMKCIALGAVEFLQKPLSPEKLKNIWQHVVHKAFNDGGSNVSISLKPVKESVVSMLHLETDMTIEEKDPAPSTPQLKQDSRLLDGDCQENINFSMENVNSSTEKDNMEDHQDIGESKSVDTTNRKLDDDKVVVKEERGDSEKEEEGETGDLISEKTDSVDIHKKEDETKPINKSSGIKNVSGNKTSRKKVDWTPELHKKFVQAVEQLGVDQAIPSRILELMKVGTLTRHNVASHLQKFRQHRKNILPKDDHNHRWIQSRENHRPNQRNYNVFQQQHRPVMAYPVWGLPGVYPPGAIPPLWPPPLQSIGQPPPWHWKPPYPTVSGNAWGCPVGPPVTGSYITPSNTTAGGFQYPNGAETGFKIMPASQPDEEMLDQVVKEAISKPWLPLPLGLKPPSAESVLAELTRQGISAVPSSSCLINGSHRLR

SEQ ID NO: 1219 - DNA, 1087 bp, Arabidopsis thaliana
  G721,family:GARP
cacattattcgagagaaatggaatcagccaatcactctctttcctccatatataaaatctagccaatattcacaaataataactacttccttcgttcttttccttaccaaaagatccacctcgaacctctctcctccgtcttcctccgcagccgccgtcactatcaccgcagctagaatgagagaagataatccaaattggttccttagatgggaagaagagcttccatctccagaagaactcatccctatctctcaaaccttaatcactcctcatctagctctcgctttccaaatcggaagtcctaatcatcatctcggatcaaagagaaccaccgcgatttatcaccagaagcttcaatcctccaccactccaacaactccaactccaactcctccaccgatgatgatgaattctgatttcggcggtggcgattccacggatcttggttcaggatcaataggaggagagccagcaagaacgttgaaacggccgcgtctagtgtggacgcctcagctacacaaacgtttcgtggatgcggttggacacttagggatcaaaaacgcagttccaaagactataatgcagcttatgagcgttgaaggattgactagagagaacgttgcgagtcatcttcagaaatatcgtctttaccttaggagaatgcaaggcgggaacggtaacggaatcactggaggacacgtcatcgtctctgattcggctactgatcggctatttgctagctcaccggttccagctcatttcttgagcccggattacttgatgccgccattagagcattcgtatatggggaaacatgtgattacgcagcaaaaccagtggttcgtaatctgaggtatgaagattcggaatatggtcatggtagtatgaagatgcttaagcacttccctgccggaaattaatgaaatatttgaattcttaacttcatttttatggaagtaataatgtttaaggtatgtggattatctctgtaatttgcatttgtcgtcaggatcaataatctattgttagtgtatattatttgttacgcgaacaatttaacctttgtatgatgttatcatttgaa

SEQ ID NO: 1220 - protein, 225 aa, Arabidopsis thaliana
  G721,GARP domain coordinates NA
MREDNPNWFLRWEEELPSPEELIPISQTLITPHLALAFQIGSPNHHLGSKRTTAIYHQKLQSSTTPTTPTPTPPPMMMNSDFGGGDSTDLGSGSIGGEPARTLKRPRLVWTPQLHKRFVDAVGHLGIKNAVPKTIMQLMSVEGLTRENVASHLQKYRLYLRRMQGGNGNGITGGHVIVSDSATDRLFASSPVPAHFLSPDYLMPPLEHSYMGKHVITQQNQWFVI

SEQ ID NO: 1221 - DNA, 1882 bp, Arabidopsis thaliana
  G722,family:GARP
atacaactttttgtctctttctctactaataataataatccgaactttgtttgttcttctacttcaattcataatctttgacggcgatgactatggagcaagaaattgaagtcttggaccagtttccggttgggatgagagttcttgctgttgacgatgaccagacttgtctccgtattctccagactttgcttcagcgctgccaatatcacgttacaacaacgaatcaggcacagaccgcattggagttgttgagggagaacaagaataagtttgatcttgttattagcgatgtcgacatgccagacatggatggtttcaagctgcttgagcttgttggtcttgaaatggacttacctgtcataatgttatctgcgcatagcgatccaaagtatgtgatgaaaggagtcaagcacggtgcctgtgattatctgcttaaaccggttcgaattgaggagcttaagaacatatggcaacatgttgtgagaaagagcaaacttaagaagaataagagcaatgtgagtaatggttcaggaaactgtgataaagcaaacagaaaacgtaaagaacagtatgaagaggaggaagaggaagaaagagggaatgataatgatgatccaacggcgcagaagaagcctcgtgttctttggacgcatgagctgcacaataaattcctagcagctgttgatcatttaggcgttgagagagctgttccaaaaaagattctagatctgatgaatgttgacaaactcactagagagaatgttgcaagccaccttcagaaattccgcgttgctctgaagaaggtgtctgatgacgccattcaacaagctaacagggcggctattgactcacattttatgcaaatgaattctcagaaaggacttggtggcttctaccaccaccaccgcggaatacctgttggatccggtcagttccatggtggaaccacaatgatgaggcattactcttcaaataggaatcttggtcgtctgaattcccttggagcaggaatgttccaaccagtctcatcatcgtttcctcgtaaccataatgatggaggaaacatacttcagggtttgccgctagaagagcttcagatcaacaacaacatcaacagggcttttccaagctttacttcacaacaaaactctccaatggtagctcccagtaatctgttacttctcgagggtaacccgcagtcatcatctttaccctcaaacccgggtttttctcctcatttcgagatcagcaagcgtctagaacattggtcaaacgctgcattgtcaaccaacattccacagagtgatgttcattcaaaacctgacaccttggaatggaatgcgttctgcgactcagctagtccgctagtaaacccaaacctggatacaaatccggcatctctctgcagaaacacgggttttggatccacaaatgctgcacaaacagacttcttttatccattacagatgaatcagcagcctgcaaacaactcaggtccagtgacagaagctcaactgtttagaagtagcaatccaaacgaaggtttactcatgggacaacagaagcttcagagtggtttgatggcttctgatgctggttccttagatgatatagtcaattccttaatgacacaggaacagagccaatctgatttctcggaaggtgattgggatttggatggtttagctcactcggaacatgcatacgagaaactccattttcccttttctttgtcagcttgagaaacctgttttattcagacacaatcaattattattatcttttggttctgtctcttctctcttctctgtaatgaaagtgtaagctattgtttaccgctcccccactggtttgagcaacttaggaagatccaaatcca

SEQ ID NO: 1222 - protein, 552 aa, Arabidopsis thaliana
  G722,GARP domain coordinates 188-236
MTMEQEIEVLDQFPVGMRVLAVDDDQTCLRILQTLLQRCQYHVTTTNQAQTALELLRENKNKFDLVISDVDMPDMDGFKLLELVGLEMDLPVIMLSAHSDPKYVMKGVKHGACDYLLKPVRIEELKNIWQHVVRKSKLKKNKSNVSNGSGNCDKANRKRKEQYEEEEEEERGNDNDDPTAQKKPRVLWTHELHNKFLAAVDHLGVERAVPKKILDLMNVDKLTRENVASHLQKFRVALKKVSDDAIQQANRAAIDSHFMQMNSQKGLGGFYHHHRGIPVGSGQFHGGTTMMRHYSSNRNLGRLNSLGAGMFQPVSSSFPRNHNDGGNILQGLPLEELQINNNINRAFPSFTSQQNSPMVAPSNLLLLEGNPQSSSLPSNPGFSPHFEISKRLEHWSNAALSTNIPQSDVHSKPDTLEWNAFCDSASPLVNPNLDTNPASLCRNTGFGSTNAAQTDFFYPLQMNQQPANNSGPVTEAQLFRSSNPNEGLLMGQQKLQSGLMASDAGSLDDIVNSLMTQEQSQSDFSEGDWDLDGLAHSEHAYEKLHFPFSLSA

SEQ ID NO: 1223 - DNA, 1075 bp, Arabidopsis thaliana
  G724,family:GARP
ccacgcgtccgcaagatttgtgttctttttttttttgttagtgttgaggatgagagaagaagattccaattggtttgctaaatgggaagaagagcttccgtcgccggaggaactcatacctttatctcaatctttaatcacgcctgatctcgccatcgccttcgatctccaccgtaacaacaactcaaactccggtcaacctctacctcaaaccacaccgccacaacccaattcctcagccgaaatcgccggagactctaccggagacgaaccagcaagaacgctaaaacgaccgcgtttagtatggacgccacagctacacaaacgtttcgtagacgcggtggctcatctcgggataaaaaacgcggttcctaaaaccatcatgcagcttatgagcgttgatggtttaacaagagaaaacgtcgctagccatttgcaaaaatacagactttacctcaaaagaatgaaatccggcggcggaggaggcggcagcggtgattccgatcatctctttgccagctcacctgttcctccacatttcctccatccgacaagtagacagagctccgaccttttcataccctcttttgtcccaatttcaactcagcagcaacatatcgcagcaccaccgtctcagttcctccaccgacaaatctccgccgttaatttcacttcaccgaccaaagcgaccgaccaagcaatgttcttggctaggcagcagagtgaactacagcaaccagttttcaaaccatcttcattgcatttacatagtcaagtcgctaattacacgcaagatttgaaatcaggagccaaaacggtcttgactctgtttccaactcgagacgattgaatttttattaaacgtcaacaatccgagttctgctttttttttctggtcttgctgttgtgactagatctttaatgtttctaatgtttccacgatcttgaggaacatttggtctccttaaagattgagttttactctgtaatgaaatgcataaaaagaagtgatctttcacttgttgtctagaaaaaaaaaaaaaaaaaaaaaaaaaaaaaaaaaaaaaaaaaaaaa

SEQ ID NO: 1224 - protein, 266 aa, Arabidopsis thaliana
  G724,GARP domain coordinates 86-134
MREEDSNWFAKWEEELPSPEELIPLSQSLITPDLAIAFDLHRNNNSNSGQPLPQTTPPQPNSSAEIAGDSTGDEPARTLKRPRLVWTPQLHKRFVDAVAHLGIKNAVPKTIMQLMSVDGLTRENVASHLQKYRLYLKRMKSGGGGGGSGDSDHLFASSPVPPHFLHPTSRQSSDLFIPSFVPISTQQQHIAAPPSQFLHRQISAVNFTSPTKATDQAMFLARQQSELQQPVFKPSSLHLHSQVANYTQDLKSGAKTVLTLFPTRDD

SEQ ID NO: 1225 - DNA, 2007 bp, Arabidopsis thaliana
  G727,family:GARP
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 1226 - protein, 644 aa, Arabidopsis thaliana
  G727,GARP domain coordinates 226-269
MVNPGHGRGPDSGTAAGGSNSDPFPANLRVLVVDDDPTCLMILERMLMTCLYREQRAHCLCFGRTKNGFDIVISDVHMPDMDGFKLLEHVGLEMDLPVINLNVLKPLVIVMSADDSKSVVLKGVTHGAVDYLIKPVRIEALKNIWQHVVRKKRNEWNVSEHSGGSIEDTGGDRDRQQQHREDADNNSSSVNEGNGRSSRKRKEEEVDDQGDDKEDSSSLKKPRVVWSVELHQQFVAAVNQLGVDSELKTCLLMHLCVSIGNIVEFQKYRIYLRRLGGVSQHQGNMNHSFMTGQDQSFGPLSSLNGFDLQSLAVTGQLPPQSLAQLQAAGLGRPTLAKPGMSVSPLVDQRSIFNFENPKIRFGDGHGQTMNNGNLLHGVPTGSHMRLRPGQNVQSSGMMLPVADQLPRGGPSMLPSLGQQPILSSSVSRRSDLTGALAVRNSIPETNSRVLPTTHSVFNNFPADLPRSSFPLASAPGISVPVSVSYQEEVNSSDAKGGSSAATAGFGNPSYDIFNDFPQHQQHNKNISNKLNDWDLRNMGLVFSSNQDAATATATAAFSTSEAYSSSSTQRKRRETDATVVGEHGQNLQSPSRNLYHLNHVFMDGGSVRVKSERVAETVTCPPANTLFHEQYNQEDLMSAFLKQV

SEQ ID NO: 1227 - DNA, 1182 bp, Arabidopsis thaliana
  G730,family:GARP
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 1228 - protein, 322 aa, Arabidopsis thaliana
  G730,GARP domain coordinates 169-217
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 1229 - DNA, 834 bp, Arabidopsis thaliana
  G732,family:bZIP
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 1230 - protein, 171 aa, Arabidopsis thaliana
  G732,bZIP domain coordinates 31-91
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 1231 - DNA, 1707 bp, Arabidopsis thaliana
  G748,family:Z-Dof
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 1232 - protein, 448 aa, Arabidopsis thaliana
  G748,Z-Dof domain coordinates 112-140
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 1233 - DNA, 1423 bp, Arabidopsis thaliana
  G749,family:Z-C3H
aaaaaaagaactctttcgtcgactaatgtgatttattgttcaccggagtattaaagaagatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgacctgctcatgtaaagaaaaaaatctgaccgtatttcgaagtctcattggcttttttggatatcttccaaggaaaagaggaagggatcttagtgtgttcatattattttatttactaatctcgtattttatctgctaataagaattaattatggattttggggcctgatttttctaagatgatcgttgtatagatgtgccttagggttttaattatgaaatagtattaatataatcgtgttttataagactataatgttagattgtaaccacttggtactaatctatgaatgaatgcaaattattat

SEQ ID NO: 1234 - protein, 356 aa, Arabidopsis thaliana
  G749,Z-C3H domain coordinates 125-177
MMIGETRRTYPTVEIPPWPVLEELTTSEFFSPVMNSPDCSMLEALAGLQRYLPSNEPDPESYPDLLGPDSPIDAYSCDHFRMYDFKVRRCARGRSHDWTECPYAHPGEKARRRDPRKYHYSGTACPDFRKGGCKKGDSCEFAHGVFECWLHPARYRTQPCKDGGNCLRKICFFAHSPDQLRFLHTRSPDRVDSFDVSSPIRARAFQLSISPVSGSPPMSPRADSESSPMTQSLSRSLGSCSINDVVPSFRNLQFNSVKSFPRNNPLFGFGSPRGSILGPGFQSLPTTPTRPGNLDIWEYGLEEEPVMERVVESGRELREKMREKLHKENCMDRVAQDPDQNLGEAPDVGWVSDLLM

SEQ ID NO: 1235 - DNA, 1299 bp, Arabidopsis thaliana
  G751,family:Z-Dof
tcttgccaaaataaaaaataaaaaaggagtttgttgtgaagccaatgaacgagatcgtgacaaacacatgcctaaaacaacagtcgaatcctccttctcctgctactcctgtggaaaggaaggcaagaccggagaaagaccaggctttgaactgtccaagatgcaactccttaaacaccaagttctgttactacaacaactacagcctgacgcagcccaggtacttttgtaaagactgcaggaggtattggaccgcaggtggttccctcaggaacatccccgtcggtggcggcgtccgcaagaacaagagatcttcttccaattcctcttcctcttcaccctcttcgtcttcttcttcaaagaaacctctttttgccaacaacaacacgcctacgcctcctcttcctcatcttaaccctaagattggtgaagcagccgctactaaagttcaagacttgacgttttctcaagggtttgggaacgcccacgaggttaaagatctcaacttggcgttttctcaagggtttgggatcggtcacaatcatcacagtagtatcccagagtttctgcaagtagtacccagcagcagtatgaagaacaacccactggtctcaacttcctcgtctttggagcttttagggatctctagttcctctgcttcctctaactcacgccctgctttcatgtcttatccaaatgttcatgattcatcggtctacacagcatccgggtttggtctgagttacccacagtttcaagagttcatgagaccagctttgggattctctcttgatggtggggatcctctacgtcaagaagaggggtccagtggcactaataatggaaggccgttgctgccatttgagagcctcctcaaacttccagtttcatcatcaagcaccaatagtggtgggaatggcaatctgaaagagaataatgatgagcatagtgatcatgaacatgagaaagaagaaggagaagctgaccaatctgttgggttttggagtggcatgttaagtgctggtgcttctgctgctgcatctggtggttcatggcaataattttagtcatggaccccatcccatgagagtttttagaagaaatgattacatttttcacccatgttttaaaaagatgagagggttaactatataatctgggtgcttactattttagtccttttcctttggtttccttctccttttctaaaaattattattaactttgttgggttggggatggatactgtatgtatttagactctcttttaaatcaatctcagttgttagttacctaaaa

SEQ ID NO: 1236 - protein, 338 aa, Arabidopsis thaliana
  G751,Z-Dof domain coordinates 37-82
MNEIVTNTCLKQQSNPPSPATPVERKARPEKDQALNCPRCNSLNTKFCYYNNYSLTQPRYFCKDCRRYWTAGGSLRNIPVGGGVRKNKRSSSNSSSSSPSSSSSSKKPLFANNNTPTPPLPHLNPKIGEAAATKVQDLTFSQGFGNAHEVKDLNLAFSQGFGIGHNHHSSIPEFLQVVPSSSMKNNPLVSTSSSLELLGISSSSASSNSRPAFMSYPNVHDSSVYTASGFGLSYPQFQEFMRPALGFSLDGGDPLRQEEGSSGTNNGRPLLPFESLLKLPVSSSSTNSGGNGNLKENNDEHSDHEHEKEEGEADQSVGFWSGMLSAGASAAASGGSWQ

SEQ ID NO: 1237 - DNA, 1939 bp, Arabidopsis thaliana
  G756,family:Z-C3H
gcttcaaattctgcttcagaagactcttagaaaatggaaaaagttacaaacaaagaataatatttattttctgtcagtttttctgatcatcaattacttttcttgaatctacaggatagtattatggaaaaagatagtattatgtgcagtggaccaaagagcaatctctgctcttcaagaaccttaacagaaatcgaatcaaggcaaaaggaagaagaaacaatgcttctcctcgaattcgctgcttgtgatgatcttgactcgttcaagagagaggttgaagagaaagggcttgatttggatgagtcagggttatggtattgcagacgtgtcggttctaagaagatgggtcttgaagaaagaacacctttaatggttgcagctatgtatggaagcataaaggttttgactttcatcgtttccactggaaaatctgatgtgaacagagcttgtggtgaagagagagttactccgcttcactgtgctgttgctggctgttctgtgaatatgattgaagtcatcaatgtcttgcttgatgcttctgctttggttaactctgttgatgctaatgggaatcaacctttggatgtgtttgttcgagtttcgaggtttgtggctagtccgaggaggaaagcggttgagttgttgctgagaggaggaggtgttggaggattgatcgatgaggcggttgaagaagagatcaagattgtctctaagtatccagctgatgcttctttaccggatataaacgaaggggtttatggaagtgatgagtttaggatgtatagctttaaggttaagccatgttctagggcttattctcatgattggaccgagtgtgcttttgttcatccgggagaaaatgcgaggaggagagatccgaggaagtatccttacacttgtgtcccctgtcccgagttccgtaaaggatcatgcccgaaaggagattcttgcgagtatgctcacggggttttcgagtcgtggcttcaccccgcgcagtataaaacccggctttgtaaagatgaaacgggttgtgcaaggaaagtttgtttctttgctcataaacgcgaagagatgagacctgttaatgcttcaactggctctgccgtggctcagtctccgtttagcagcttggagatgatgccagggttgtctcctcttgcttattcttcaggagtttcgactcctccggtttctccaatggctaatggtgttccttcctctccaagaaacggcggatcatggcagaacagagtcaatacccttactccaccggctttgcagctcaatggtggaagcagattgaagtccacactgagcgctagagatatcgatatggagatggagatggaattgagactccgcggttttggcaacaatgtggaagagacgttcgggtcttatgtttcctctccaagtaggaattctcaaatgggtcaaaacatgaaccaacattatccatcttccccggtgagacaaccgccatctcaacacgggttcgaatcttcagcagctgcagcggttgcagtgatgaaagcgagatcaaccgcctttgcgaaacgtagcttgagcttcaaaccagctactcaagcagcaccacagtcgaatctctcggattggggatctccaaacgggaagctggaatggggaatgaaaggagaagagctgaataagatgagaagaagtgtttcctttggaatccatggaaacaacaacaataacgcagctagagactacagggacgagccagatgtgtcatgggttaactctttagttaaagacagtactgtggtgtctgagagaagctttggaatgaatgagagggttcggataatgtcgtgggctgagcaaatgtacagagagaaggagcagactgtggtgtaaacacacacaaagatggtttcttatatatattgcttttgggccatctctgcaaatt

SEQ ID NO: 1238 - protein, 586 aa, Arabidopsis thaliana
  G756,Z-C3H domain coordinates 199-319
MEKDSIMCSGPKSNLCSSRTLTEIESRQKEEETMLLLEFAACDDLDSFKREVEEKGLDLDESGLWYCRRVGSKKMGLEERTPLMVAAMYGSIKVLTFIVSTGKSDVNRACGEERVTPLHCAVAGCSVNMIEVINVLLDASALVNSVDANGNQPLDVFVRVSRFVASPRRKAVELLLRGGGVGGLIDEAVEEEIKIVSKYPADASLPDINEGVYGSDEFRMYSFKVKPCSRAYSHDWTECAFVHPGENARRRDPRKYPYTCVPCPEFRKGSCPKGDSCEYAHGVFESWLHPAQYKTRLCKDETGCARKVCFFAHKREEMRPVNASTGSAVAQSPFSSLEMMPGLSPLAYSSGVSTPPVSPMANGVPSSPRNGGSWQNRVNTLTPPALQLNGGSRLKSTLSARDIDMEMEMELRLRGFGNNVEETFGSYVSSPSRNSQMGQNMNQHYPSSPVRQPPSQHGFESSAAAAVAVMKARSTAFAKRSLSFKPATQAAPQSNLSDWGSPNGKLEWGMKGEELNKMRRSVSFGIHGNNNNNAARDYRDEPDVSWVNSLVKDSTVVSERSFGMNERVRIMSWAEQMYREKEQTVV

SEQ ID NO: 1239 - DNA, 885 bp, Arabidopsis thaliana
  G763,family:NAC
tctctctctttgtttggaaccaccatggataatgtcaaacttgttaagaatggtgttttgagattgccacctggattcagattccatcctactgatgaagaacttgtggttcaataccttaagaggaaagtttgttcttctcctttgccagcttcaatcatccctgagtttgatgtttgcagagctgatccttgggatttacctcgcaatttggagaaagagaggtacttctttagcacaagggaagctaaatacccaaatgggaaccggtctaaccgggcaactgggtctggttattggaaagctaccggtattgataaacgggttgtgacctctagaggaaatcaaatcgttggtttgaagaaaactcttgtcttctacaaaggcaaaccacctcatggctcaagaaccgattggatcatgcacgaatatcgcctctcttcttctcctccgagttctatgggtcccactcagaactgggtactctgtcgtatcttcttgaagaaaagagccggtaacaagaacgacgacgacgacggagatagccgtaatcttagacataataataataacaattcgagtgaccaaattgagataattacaacagaccaaacagatgataaaacaaaaccaatcttctttgatttcatgagaaaagaaagaacaacagatttgaaccttttgccgagctctccttcttccgatcatgcttcaagtggagtcacgacggagatcttctcttcttccgatgaagagaccagtagttgcaatagtttcagatgaaatctttaatttaattttaatgttgactatcttaataagttattatagttttatattaatacgactctctttcctttttattccatttttacttgaaaacga

SEQ ID NO: 1240 - protein, 252 aa, Arabidopsis thaliana
  G763,NAC domain coordinates 17-157
MDNVKLVKNGVLRLPPGFRFHPTDEELVVQYLKRKVCSSPLPASIIPEFDVCRADPWDLPRNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 1241 - DNA, 1198 bp, Arabidopsis thaliana
  G764,family:NAC
atcgaattcgcggccgctcgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaa

SEQ ID NO: 1242 - protein, 318 aa, Arabidopsis thaliana
  G764,NAC domain coordinates 27-171
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 1243 - DNA, 1027 bp, Arabidopsis thaliana
  G783,family:HLH/MYC
gtctacagtttccgacgagattctcaccggagaaagaaaggtgacttgacagagaatcttgttctgtaataaaagcaaagatggtatcgaaaactccttctacatcgtctgatgaagcaaatgctactgcagatgaaagatgtagaaaaggtaaagtaccgaaaaggatcaacaaggccgttcgtgagaggcttaagcgtgagcatttgaatgagcttttcattgaattagccgatactcttgaactgaatcaacagaacagtgggaaagcttctatactatgcgaagctactcgattcttgaaggacgtgtttggtcaaattgagtctcttagaaaggagcatgcttctctcctatctgaatctagctatgtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaacccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctcaaaaaaaaaaaaaaaaaaa

SEQ ID NO: 1244 - protein, 240 aa, Arabidopsis thaliana
  G783,HLH/MYC domain coordinates 24-82
MVSKTPSTSSDEANATADERCRKGKVPKRINKAVRERLKREHLNELFIELADTLELNQQNSGKASILCEATRFLKDVFGQIESLRKEHASLLSESSYVTTEKNELKEETSVLETEISKLQNEIEARANQSKPDLNTSPAPEYHHHHYQQQHPERVSQFPGLPIFQGPGFQQSATTLHPPATVLVLPIQPDPQTQDISEMTQAQQPLMFNSSNVSNPCPRYASAADSWSSRLLGERLKASE

SEQ ID NO: 1245 - DNA, 952 bp, Arabidopsis thaliana
  G787,family:HLH/MYC
ccccattcgcgttcttatataaagctcacagttcgagagagacaagagaccaacgaaacgaactagagacagtttgattcgaaaatcttgtcggaaaatggaggatatcgtcgaccaagaattaagcaattactgggaacctagctccttcctccaaaacgaagacttcgaatacgacagaagctggcctttggaagaagccatttctgggtcgtatgattcgagttcgccggatggagctgcttcgtcgccggcttctaagaatattgtgtcggagagaaacagaagacagaaacttaaccagagactcttcgctcttcgatcagttgttcccaatatcactaagatggataaagcctcaataatcaaagatgctattagttacatagaaggattacaatatgaagaaaagaagctcgaagctgagatcagagaacttgaatctacaccaaagagtagccttagtttcagcaaagattttgatcgtgatttacttgttcctgtcacatccaagaagatgaagcagcttgattctggttcttccacttctctcatcgaagttctcgaattgaaggtaacattcatgggagagaggacaatggtggtgagtgtaacatgtaataagaggacagatacaatggtgaaactgtgtgaagtctttgagtcattgaatctcaaaatcctcacttccaatctcacctctttctctggcatgatcttccacactgtctttattgaggcggatgaagaagaacaagaggtgttgcggttaaaaatagaaacaggaataggagcttataatgaaactcaaagccctactttgagcatcgactctctttactaataatactttttttcttccttttttggttcattttggcttctctctttacaataatgtatgtctctcttttcatttttatgatctcctacgtttgtttgtcccacccaa

SEQ ID NO: 1246 - protein, 248 aa, Arabidopsis thaliana
  G787,HLH/MYC domain coordinates 49-105
MEDIVDQELSNYWEPSSFLQNEDFEYDRSWPLEEAISGSYDSSSPDGAASSPASKNIVSERNRRQKLNQRLFALRSVVPNITKMDKASIIKDAISYIEGLQYEEKKLEAEIRELESTPKSSLSFSKDFDRDLLVPVTSKKMKQLDSGSSTSLIEVLELKVTFMGERTMVVSVTCNKRTDTMVKLCEVFESLNLKILTSNLTSFSGMIFHTVFIEADEEEQEVLRLKIETGIGAYNETQSPTLSIDSLY

SEQ ID NO: 1247 - DNA, 1913 bp, Arabidopsis thaliana
  G789,family:HLH/MYC
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 1248 - protein, 444 aa, Arabidopsis thaliana
  G789,HLH/MYC domain coordinates 253-310
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 1249 - DNA, 1250 bp, Arabidopsis thaliana
  G790,family:HLH/MYC
atatgttttttttcacgagaataaaatttggtttaaaattccaaaattctctcaaatctttaatatatattttccaataacaaaagatatatatctcctcaaattttctagggaatacagtatttgtgtgtttgagacagatttttgcagattctctcgttctgcattctctgttcttcttctgatgtatccatcaatcgaagacgatgatgatcttctcgctgctctttgttttgatcaaagcaatggagtagaagatccttatggatatatgcaaacaaatgaagataacatatttcaggattttgggtcttgtggtgtgaatctgatgcagccacaacaagaacaatttgattcttttaatggaaatcttgagcaagtttgtagtagctttagaggaggaaacaatggagttgtttatagtagtagcattggatcagcacaattggatttggctgcatcgtttagtggagttttgcagcaagagacacatcaagtctgtggctttagaggacaaaacgacgattctgcagtgcctcatttgcagcagcaacaaggacaggtgtttagtggtgtagtggaaatcaattcttcgtcatctgttggagctgttaaggaagagtttgaggaagaatgttcggggaagaggagacgaactggatcatgtagcaagccaggaaccaaagcctgtcgcgagaaactaagaagggaaaagctaaatgacaagttcatggacttgagctctgttttagagcctggcaggactccaaagacggataaatcagctatactcgacgatgcaatccgggttgtgaatcagcttagaggtgaagctcatgagcttcaagaaaccaaccaaaagcttctagaagagatcaagagtctaaaggcggataaaaacgagctacgagaggaaaagctggtgttgaaggcggagaaggagaagatggagcaacagttaaaatctatggtggttccatcaccaggtttcatgccctcccagcatccagcagctttccattcccataagatggcggtggcttacccttacggctactatcctccaaacatgccaatgtggtcacccttacctcctgctgaccgtgatacgtctcgtgatctcaaaaatcttcctcctgttgcttaatcttcttcatgttgattcatcattgatcattgttatcaatcccttaggaatttttgttccttcagatgattctttaatcagtagttttgcagtaaccatttgg

SEQ ID NO: 1250 - protein, 320 aa, Arabidopsis thaliana
  G790,HLH/MYC domain coordinates NA
MYPSIEDDDDLLAALCFDQSNGVEDPYGYMQTNEDNIFQDFGSCGVNLMQPQQEQFDSFNGNLEQVCSSFRGGNNGVVYSSSIGSAQLDLAASFSGVLQQETHQVCGFRGQNDDSAVPHLQQQQGQVFSGVVEINSSSSVGAVKEEFEEECSGKRRRTGSCSKPGTKACREKLRREKLNDKFMDLSSVLEPGRTPKTDKSAILDDAIRVVNQLRGEAHELQETNQKLLEEIKSLKADKNELREEKLVLKAEKEKMEQQLKSMVVPSPGFMPSQHPAAFHSHKMAVAYPYGYYPPNMPMWSPLPPADRDTSRDLKNLPPVA

SEQ ID NO: 1251 - DNA, 992 bp, Arabidopsis thaliana
  G792,family:HLH/MYC
tcttttttcttccgtttttccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacatagtccactgcaacttaaaatgtaaaattgaaataagcttgcactaaaaatcaaatctcattgtgcaaaaagttggataatttggaaatcattgttttacaaa

SEQ ID NO: 1252 - protein, 226 aa, Arabidopsis thaliana
  G792,HLH/MYC domain coordinates 63-122
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 1253 - DNA, 1420 bp, Arabidopsis thaliana
  G793,family:HLH/MYC
cattctctcacctaacaactccacacaagattcttcgcatggaaagttgttcttcgacttctcttctctaactcgctatcttttaactcacccagctccactgagtcgaaaatttcaaacctttactcgtttccttcatggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctattttccatgggcagccaatgtcacagccagctccaccaatgccgcatcaacagtctactattcggcctagagttagggctaggcgaggtcaagctaccgatccacatagcatcgctgagaggctccgaagggaaagaatagcagaacggatcaggtcgttgcaggaacttgtacctaccgttaacaagacagatagggctgctatgatcgacgagattgtcgattatgtaaagtttctcaggctccaagttaaggtcctgagcatgagccgtcttggtggagccggtgctgtcgcaccactagtcactgaaatgccattatcttcatcagttgaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtagatttttgttcatccaacggtccccagctgatgattgacattttgctctgtttcccactactagacttttgtgactcatgaaaggtaagtaaaaaggcattggagatggaatctaagtaggatttgtgcagtaaagaagtaaaacgggatctgtcaaaagaaggaaaaagctctcgcttgcttggctagtatttatcattttgatgaaagtaactcttttttgttcaaagactttagtgtgattttcaggaccaagggctttgagggtagtgctagctgtagtaatagtaatgaaggtgtgggatcgtgtttttgaattatgtaaaaaaggaagaaaaaacaaatgttggtattatattatggttttgcctgaaa

SEQ ID NO: 1254 - protein, 302 aa, Arabidopsis thaliana
  G793,HLH/MYC domain coordinates 147-204
MANNNNIPHDSISDPSPTDDFFEQILGLSNFSGSSGSGLSGIGGVGPPPMMLQLGSGNEGNHNHMGAIGGGGPVGFHNQMFPLGLSLDQGKGHGFLKPDETGKRFQDDVLDNRCSSMKPIFHGQPMSQPAPPMPHQQSTIRPRVRARRGQATDPHSIAERLRRERIAERIRSLQELVPTVNKTDRAAMIDEIVDYVKFLRLQVKVLSMSRLGGAGAVAPLVTEMPLSSSVEDETQAVWEKWSNDGTERQVAKLMEENVGAAMQLLQSKALCIMPISLAMAIYHSQPPDTSSSIVKPEMNPPP

SEQ ID NO: 1255 - DNA, 1713 bp, Arabidopsis thaliana
  G8,family:AP2
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 1256 - protein, 449 aa, Arabidopsis thaliana
  G8,AP2 domain coordinates 151-217,243-293
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 1257 - DNA, 1730 bp, Arabidopsis thaliana
  G810,family:HS
cggagtagtgaatctcggaattgttgaagaagacggtacaccggaatcaattgcgattttgatttatgggaacggtttgcgaatctgtagcgacggcgaaatcttcgacggcggtgatgagctccattccgccttttctgagcaaaacgtacgatatggttgacgatccattgacggacgacgtggtgtcttggagcagcggaaacaacagcttcgtggtttggaacgtgcctgagttcgccaaacagtttctaccaaagtatttcaagcacaacaatttctccagcttcgtcagacagctcaatacttatggttttagaaaagttgatccagaccgctgggagtttgcaaacgagggctttttaagaggccaaaagcaaatactaaagagtattgtccggcgaaaacctgcacaagtgcagcctccacaacaacctcaagttcagcactcatctgtgggtgcgtgcgttgaagtgggcaaatttggactcgaagaggaagtggaaagacttcagcgcgataagaacgtccttatgcaggaacttgtaaggttgaggcagcaacaacaagttaccgaacatcatctgcagaatgtggggcagaaagttcatgtgatggagcagaggcagcaacagatgatgtcctttctagcaaaggctgtccaaagtccaggtttcttaaaccaattttctcagcagagtaatgaagcaaaccaacacatttctgaaagcaacaaaaagaggaggctacctgttgaggaccagatgaattctggcagtcatggggttaatggtcttagccgccagattgtgagatatcagtcatcgatgaacgatgcaacaaacactatgcttcaacagatacagcagatgagtaatgcacctagccatgaatctctctcaagcaataatggtagctttcttttgggcgatgttccaaattctaacatttcagacaatgggagctcctcaaatggatcacctgaagttacattggcagatgtttcatccattcctgcaggcttctatcctgcaatgaagtaccacgagccttgtgaaacaaatcaagtcatggagaccaatttgcctttttctcaaggtgatctcttacctccaacgcaaggagcagcagcttctgggagctcaagttcggatcttgttggatgcgagacagataatggagagtgtttggatccaataatggctgttttggatggcgcactcgaactagaagctgataccttaaatgagttgcttcctgaagtccaagattctttttgggaacagttcattggtgagagcccagtgattggtgagacagatgagttaatctcaggatcagtggaaaatgaactgatattggagcaactagagttacaatcaaccctgagtaatgtgtggagcaagaatcaacaaatgaaccatcttactgaacagatgggacttctcacatcagatgctctcagaaaatgagattgccacaggccacaatctttcctcacgagatgggttaagattttgtggagccgcaacaacaaaaagaatatgaccaaaggaggtactatgtatgtatgtatcaaactgttgtaactctaattcttgtcaatgtataataaaataagagaaatattgccttaaaagatttttgcattgcaatatctttgtttgttactgacagaatgaaaaggagatgcttcaaagtgagagatattcttctgttcttgtgtatgt

SEQ ID NO: 1258 - protein, 468 aa, Arabidopsis thaliana
  G810,HS domain coordinates 23-114
MGTVCESVATAKSSTAVMSSIPPFLSKTYDMVDDPLTDDVVSWSSGNNSFVVWNVPEFAKQFLPKYFKHNNFSSFVRQLNTYGFRKVDPDRWEFANEGFLRGQKQILKSIVRRKPAQVQPPQQPQVQHSSVGACVEVGKFGLEEEVERLQRDKNVLMQELVRLRQQQQVTEHHLQNVGQKVHVMEQRQQQMMSFLAKAVQSPGFLNQFSQQSNEANQHISESNKKRRLPVEDQMNSGSHGVNGLSRQIVRYQSSMNDATNTMLQQIQQMSNAPSHESLSSNNGSFLLGDVPNSNISDNGSSSNGSPEVTLADVSSIPAGFYPAMKYHEPCETNQVMETNLPFSQGDLLPPTQGAAASGSSSSDLVGCETDNGECLDPIMAVLDGALELEADTLNELLPEVQDSFWEQFIGESPVIGETDELISGSVENELILEQLELQSTLSNVWSKNQQMNHLTEQMGLLTSDALRK

SEQ ID NO: 1259 - DNA, 1248 bp, Arabidopsis thaliana
  G811,family:HS
ccaccaccaacaacaaacatataaaccataaggaaaacagagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttagactttattatggttatattattattattatttattttttgtgtgtttgttcttaattattttatgtataccccaaagaaagaaagaaaataaggcagatccatagttgagtcagtagtcatcgtttgtagaaagttttgacagtatataatttctgattatatttgttaaaa

SEQ ID NO: 1260 - protein, 330 aa, Arabidopsis thaliana
  G811,HS domain coordinates 17-108
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 1261 - DNA, 952 bp, Arabidopsis thaliana
  G812,family:HS
tcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 1262 - protein, 272 aa, Arabidopsis thaliana
  G812,HS domain coordinates 29-120
MMNPFLPEGCDPPPPPQPMEGLHENAPPPFLTKTFEMVDDPNTDHIVSWNRGGTSFVVWDLHSFSTILLPRHFKHSNFSSFIRQLNTYGFRKIEAERWEFANEEFLLGQRQLLKNIKRRNPFTPSSSPSHDACNELRREKQVLMMEIVSLRQQQQTTKSYIKAMEQRIEGTERKQRQMMSFLARAMQSPSFLHQLLKQRDKKIKELEDNESAKRKRGSSSMSELEVLALEMQGHGKQRNMLEEEDHQLVVERELDDGFWEELLSDESLASTS

SEQ ID NO: 1263 - DNA, 2325 bp, Arabidopsis thaliana
  G819,family:AKR
tatagaccaacgaagaagaagacgaagaagcagtctctcaaacttcttctccagatccgaatctcactctcatttctccgatctctctatttgaatgacctacaatttcgcatctcttttgatcttgatctctgtttctctccttctactgaatctcttgttttgagtaatcactaatatacacaacggcggcgatgagggggagatcagaaggagggaagaaaaagccggtgattgtgttactctgcgttgcatcagtagtgcttgtttttgtatatctcttctttggttcctctaaccataaagctattgagtatgggaggaaacttggtttgggtggtgatgatgatgatagtactaagaaagatgacacttctagctctttttatgtagaagatgtagtagggaatggtttcactcccagaagctttcctgtgtgtgatgatcgacactcggagcttattccttgcttagataggaatcttatataccaaatgagattgaagcttgatttgtctttgatggagcattatgaacgtcactgtcctcctcctgaaaggaggtttaattgcttgattcctcctcgtccagggtataagattccaatcaagtggccgaaaagcagagacgaagtttggaaagtgaacattcctcatactcacttagcgcatgagaagtctgaccaaaactggagggttgttaaaggagagaaaatcaatttccctggtggaggcacacattttcattatggtgctgataagtatattgcatcaatggcaaatatgcttaattttccgaacaatgttttgaacaatgggggaaggctgaggacatttcttgatgttggctgtggtgttgctagctttggaggttatcttcttgcatcagaaattatgacgatgtctttggcacctaatgatgttcatcagaaccaaatccaatttgctcttgagagagggattcctgcatacctcggcgttctagggaccaagaggctcccatacccaagcagatcctttgaacttgctcactgttcacgttgtcgtatcgattggcttcaaagagatggtattcttcttctcgagctagacagggtgctaagacctggtggctattttgcatattcatctccagaagcatatgcacaagatgaagaggacctcagaatatggagagaaatgagtgctcttgtgggccgtatgtgttggacgatagctgcaaaaaggaatcaaactgtaatttggcaaaaacctttgacaaatgattgttatttgggaagagaacctggaacccagcctcctctttgcaattctgacagtgaccctgatgctgtgtatggtgtaaacatggaagcatgcattactcaatacagtgaccatgaccacaaaaccaagggaagtggattggctccatggccagctcgattaacctctcctcctcctcggctagctgactttggctattccactgacatttttgagaaggatacagaaacttggaggcagagagtagatacttattgggatctcttgagtcctaaaattcaatcagacactgtaaggaacataatggacatgaaagcaagcatgggttcctttgctgctgctctgaaagaaaaagatgtttgggttatgaatgttgttcctgaagacggaccaaacacgcttaaactaatatacgacagaggcctgatgggtgctgttcatagctggtgtgaagcgttctcgacttacccgaggacttacgatttactccatgcctgggacatcatatctgatatcaagaagagaggttgcagcgcagaagatttgctgttggagatggatcgtatacttcgtccaagcggtttcatactcataagggacaaacaatccgtagtcgaccttgtgaagaagtatctcaaggctttgcattgggaagcagttgaaaccaagacagcctcggaatcagaccaagactcggacaatgtgatactcattgtccagaagaaactgtggttgacaagtgaaagcctcagagatttggagtgattacgatgatgatgatgatgaggccaaaaactgcctccaacatgaaaaaacaaaacaacattcacaagagatttctttcttgggagaatctaatcgaaaacatacaacgaagaaaattcgttttatagcggcaatttaacgttcttttctcttaaatctttctttctttacatattcatataatgtttgtatggttcgttagagaggactaaagtttcttatcaatttaaactctttttgttgcaatttatgtattaaatcattgtttaatagattgatgattattcattactaa

SEQ ID NO: 1264 - protein, 611 aa, Arabidopsis thaliana
  G819,AKR domain coordinates 88-598
MRGRSEGGKKKPVIVLLCVASVVLVFVYLFFGSSNHKAIEYGRKLGLGGDDDDSTKKDDTSSSFYVEDVVGNGFTPRSFPVCDDRHSELIPCLDRNLIYQMRLKLDLSLMEHYERHCPPPERRFNCLIPPRPGYKIPIKWPKSRDEVWKVNIPHTHLAHEKSDQNWRVVKGEKINFPGGGTHFHYGADKYIASMANMLNFPNNVLNNGGRLRTFLDVGCGVASFGGYLLASEIMTMSLAPNDVHQNQIQFALERGIPAYLGVLGTKRLPYPSRSFELAHCSRCRIDWLQRDGILLLELDRVLRPGGYFAYSSPEAYAQDEEDLRIWREMSALVGRMCWTIAAKRNQTVIWQKPLTNDCYLGREPGTQPPLCNSDSDPDAVYGVNMEACITQYSDHDHKTKGSGLAPWPARLTSPPPRLADFGYSTDIFEKDTETWRQRVDTYWDLLSPKIQSDTVRNIMDMKASMGSFAAALKEKDVWVMNVVPEDGPNTLKLIYDRGLMGAVHSWCEAFSTYPRTYDLLHAWDIISDIKKRGCSAEDLLLEMDRILRPSGFILIRDKQSVVDLVKKYLKALHWEAVETKTASESDQDSDNVILIVQKKLWLTSESLRDLE

SEQ ID NO: 1265 - DNA, 2075 bp, Arabidopsis thaliana
  G830,family:AKR
agctctcacactatccactcttcatcggcagctagatttccgggtcctcagtatcgggtcagatctagatccggatccggagacgctgagaatgaaacacttcagaactgagcgagtccgtgcgactccgaagctcttcacctacgttctcgtcggtttcatcgctctactcggcttgacttgcctctactacggctcttcgttcgctcccggatccagaaagtccgatgagttcgatggatctaataaccgcgttcgcaccggaatcggatccttgaggaatcgagatattgtgcttgcagtgagccgtttcgaagttcctaaaagtgttccgatatgtgattcgagacactcggagttgataccgtgtttggatcggaaccttcattaccagttgaaattgaaactcaatttatcgttaatggagcactatgagcatcattgtcctccatcagaacggcgtttcaattgccttgttccgcctcctgttggttataagatcccgttaaggtggcctgtgagtagagacgaggtgtggaaggcgaatatcccgcacacacaccttgctcaagagaagtctgatcagaattggatggttgttaatggtgataagatcaattttcctggtggaggaacacatttccacaacggagctgacaaatacattgtttccctggctcagatgctgaaattccctggtgacaaactcaacaatgggggaagcattcggaatgttcttgacgttggttgtggggtagctagcttcggagcctatcttctttcacatgacatcatagccatgtctcttgcccctaatgatgtccaccagaaccagatccagtttgctctagaacgagggattccatcaacacttggtgttcttgggacaaagcggcttccatacccaagcagatcatttgaacttgctcactgctctagatgtcggatagattggcttcaaagagatgggatcttgttactggaacttgataggttgctcagacctggtggctactttgtatactcgtcgcctgaagcttatgcacacgacccagagaacagaaagattgggaatgcaatgcatgatctctttaagagaatgtgttggaaggtcgtggccaaacgagaccaatctgttatatggggaaaaccgatatccaacagctgttacttgaagagggatccgggtgtcctgcctccgctttgtccttctggagatgacccagatgcaacttggaatgtctcaatgaaggcttgcatatcaccttactcagtgaggatgcacaaagaaagatggagtggactcgttccctggccacggaggctgacagctcctccaccacgtcttgaagaaattggtgtcactcctgagcaattccgtgaagatacggaaacatggcggcttagagtgatagaatactggaaactgctgaaaccaatggtgcaaaagaactccataagaaacgtgatggacatgagctcaaaccttggcggtttcgcagctgctctaaacgataaagatgtatgggtaatgaatgtcatgcccgttcaatcctctccaagaatgaagatcatttacgaccgtggccttatcggagccactcatgattggtgtgaagcctttgacacatacccacgaacgtttgatcttatccacgcatggaacaccttcacagaaacccaagcacgtggatgcagctttgttgatctgcttatcaagatggatcggatactacgcccagaaggatttgtcataattcgtgacacaactgacaatattagctatatcaagaagtatctgacattattgaaatgggataaatggtccacagagacaactccaaaaggtgatcctctgtcgaccaaagacgagatagttttgatcgccagaaagaaactttggagcttgcccgccatttcagtgtcctgaaatctaacagtcaacaggcgaatgaatgagatttacagcatcagaggcgcgtagctgaggaaaatactcagcaatggagaagtgtaaattacacgacattcatacatagttgttaacttgttatgcatttgttgtaggaaactgc

SEQ ID NO: 1266 - protein, 612 aa, Arabidopsis thaliana
  G830,AKR domain coordinates 89-601
MKHFRTERVRATPKLFTYVLVGFIALLGLTCLYYGSSFAPGSRKSDEFDGSNNRVRTGIGSLRNRDIVLAVSRFEVPKSVPICDSRHSELIPCLDRNLHYQLKLKLNLSLMEHYEHHCPPSERRFNCLVPPPVGYKIPLRWPVSRDEVWKANIPHTHLAQEKSDQNWMVVNGDKINFPGGGTHFHNGADKYIVSLAQMLKFPGDKLNNGGSIRNVLDVGCGVASFGAYLLSHDIIAMSLAPNDVHQNQIQFALERGIPSTLGVLGTKRLPYPSRSFELAHCSRCRIDWLQRDGILLLELDRLLRPGGYFVYSSPEAYAHDPENRKIGNAMHDLFKRMCWKVVAKRDQSVIWGKPISNSCYLKRDPGVLPPLCPSGDDPDATWNVSMKACISPYSVRMHKERWSGLVPWPRRLTAPPPRLEEIGVTPEQFREDTETWRLRVIEYWKLLKPMVQKNSIRNVMDMSSNLGGFAAALNDKDVWVMNVMPVQSSPRMKIIYDRGLIGATHDWCEAFDTYPRTFDLIHAWNTFTETQARGCSFVDLLIKMDRILRPEGFVIIRDTTDNISYIKKYLTLLKWDKWSTETTPKGDPLSTKDEIVLIARKKLWSLPAISVS

SEQ ID NO: 1267 - DNA, 1946 bp, Arabidopsis thaliana
  G843,family:MISC
gccgggaagaagtgcgagcttggtgccgatgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatgactcatagcttcatggtcctaacatgtacttctcgaacatatattagccatgtaaatataaaggaaggtgatgctgattttggttacacatcttgttctctgttagtttcgacaacttgacaatgtctgattgttatgaccttcaaaggctgtttcagattttttgatacaacgtttaaactgaatattgtaatgccttcactcatctgattccttcaatttttgttatatgagatcagaaagtcttgagacaaaaaaaaaaaaaaaaaaaa

SEQ ID NO: 1268 - protein, 548 aa, Arabidopsis thaliana
  G843,MISC domain coordinates 60-119,270-350
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 1269 - DNA, 1126 bp, Arabidopsis thaliana
  G865,family:AP2
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 1270 - protein, 212 aa, Arabidopsis thaliana
  G865,AP2 domain coordinates 36-103
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 1271 - DNA, 1571 bp, Arabidopsis thaliana
  G869,family:AP2
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 1272 - protein, 324 aa, Arabidopsis thaliana
  G869,AP2 domain coordinates 110-165
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 1273 - DNA, 1152 bp, Arabidopsis thaliana
  G881,family:WRKY
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 1274 - protein, 310 aa, Arabidopsis thaliana
  G881,WRKY domain coordinates 176-233
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 1275 - DNA, 2946 bp, Arabidopsis thaliana
  G886,family:BZIPT2
gaaaaagctaaactttgctctgttttttcaacaaaaaaagtgaactttgctctgttccgtccatgtccgatgatgatcggagtggaagcagaatgagatttgaagcaaacgtctagagttccgacgttatgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctaaaaaaa

SEQ ID NO: 1276 - protein, 879 aa, Arabidopsis thaliana
  G886,BZIPT2 domain coordinates 1-53,542-652
MGCGGSKVDNQPIVILCRERKELLKAASYHRSALAVAHLTYFQSLSDVGEAIQRFVDDEVVAGFSSSSSPDSPVLTLPSDEGKPTKHKRISPSSTTSISHSVIEEEDTDDDSHLHLSSGSESESEVGSKDHIQITSTPEQERSTESFPSGYHPTNYAPPVYPPGYPPGYPFSYPTGYSSGNYQPGYPNYTGENPYGNRGMYYMKKSAPQSRPFIFQPENHRVEENAQWPSDSGFRNTGVQRRSPSPLPPPSPPTVSTWDFLNVFDTYDYSNARSRASGYYPMGMASISSSPDSKEVREREGIPELEEVTEQEVIKQVYRRPKRPGLEKVKEHRDEHKHNVFPERNINKREVPMPEQVTESSLDSETISSFSGSDVESEFHYVNGGEGKSSSISSISHGAGTKSSREVEEQYGRKKGVSFELEETTSTSSFDVESSKISSLSSLSIHATRDLREVVKEIKSEFEIASSCGKEVALLLEVGKLPYQHKNNGVKVILSRIMYLVAPSTRSSHSQPRLSIRLTSRTRKMAKSYNGQDVNGGFNGNLSSTLEKLYAWEKKLYKEVKDEEKLRAIYEEKCRRLKKMDSHGAESIKIDATRAAIRKLLTKIDVCIRSVDSISSRIHKLRDEELQPQLIQLIHGLIRMWRSMLRCHQKQFQAIRESKVRSLKANTTLQNDSGSTAILDLEIELREWCISFNNWVNTQKSYVQFLSGWLTKCLHYEPEATDDGIAPFSPSQIGAPPIFIICKDWQEAMCRISGENVTNAMQGFASSLHELWEKQEEEQRVKAQSEQRDAESERSVVSKGRSESGISALDDLKVDLDSMRKRLVEERGKGKETIKLVNNASSSSLKAGLVPIFGALRKFTSEVVKAHEIVRLQHPQTSS

SEQ ID NO: 1277 - DNA, 1276 bp, Arabidopsis thaliana
  G896,family:Z-LSDlike
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 1278 - protein, 367 aa, Arabidopsis thaliana
  G896,Z-LSDlike domain coordinates 18-39
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 1279 - DNA, 1120 bp, Arabidopsis thaliana
  G897,family:Z-CO-like
aaacagtagagagagatatagagagcatcaatggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctgatattttccggtgaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaactaataaattttgatttacaatctcaaaa

SEQ ID NO: 1280 - protein, 294 aa, Arabidopsis thaliana
  G897,Z-CO-like domain coordinates 8-39,51-82
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 1281 - DNA, 863 bp, Arabidopsis thaliana
  G902,family:Z-CO-like
taattaatcagaggtttctacttattatttccacttctcatctctttcaatcgcaatctgagttctggctaaagattttgtcttgaaggtgagattcattgttccgaatagagtgagaaaaagacttataagattgaaaaagcaagatgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaagtgataaggtgagagagagagagagaaagagactctttactctgattcaaaaaatcagtttaagaagaagattgtaaaaagtttcaagaactggagatttcatgtccgttttttttccttccttctgattcttagatcgttgctggtgtaaccgagctttgttgttgaa

SEQ ID NO: 1282 - protein, 183 aa, Arabidopsis thaliana
  G902,Z-CO-like domain coordinates NA
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 1283 - DNA, 1005 bp, Arabidopsis thaliana
  G904,family:RING/C3H2C3
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 1284 - protein, 334 aa, Arabidopsis thaliana
  G904,RING/C3H2C3 domain coordinates 117-158
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 1285 - DNA, 1197 bp, Arabidopsis thaliana
  G905,family:RING/C3H2C3
tacttccaccatcaaatcgtcaaaccatttgcaaccatcgatggtggtcatgtcacgagtaagcttctactcttctttcttgctactactgttagaggtcgttgtcgctagcagcgagtttgatgatgaaggaagaacatcgttcagtccaaccacggctataatcatgatcgtactcgttagtgttttcttcgcacttggatgtatctccgtctacatgaggaggtgtctccagcacgctctggggatggacagcggtggtggtccaggaaactggcttaacgtgaggcaaacgacggagcctgggctagacgcgtctgttatagaaacgtttccaacgtttccttactctacagtgaagacgttgaggatcggtaaagaagctttggagtgtcccgtttgtctcaacgagttcgaggacgacgaaacgctgcgtttgattcctcagtgttgtcacgtgtttcatcctggttgcattgatgcctggctccgttctcagaccacatgtcctctttgccgagccaatctcgttcctgtaccgggtgagtctgtttcttcggagatacccggtttagctagagaaaccggtcagaactctctcagaacgccgattgatgataaccggaaaagggttttaacttcacctgacgagcggttgattgactcagtggcttggacgggtaaccaaagcatgccacgtaaatccatgtctacaggttggaaactagctgaattgtacagcccggctagttcaccgggccaaccggaggagaatctcgaccggtatacgctgaggttaccacaagagatacatgaccagcttgtgaactccagcctgggaaagcaagggtcaaaaggccaactggccttacctcaagaaaggagctcggttagagggttcagaaccggaagcctagggactgaaaagaactatttctactttgaacggtttgatcaagacggtcggttggaccggagaccattttctataactcctccataccatacccggtcgatacagtctccggatgagattatcaacgctagtggtaattatcaggatcgtgctggtgcacctaaaggtttgcttctagcaataaggtcaccgtttgatcggttatttactgggaagaaaaatgccggtgagcgttcgtaccttcaatccggcgatgcgagccctgtctaggcgaattacta

SEQ ID NO: 1286 - protein, 381 aa, Arabidopsis thaliana
  G905,RING/C3H2C3 domain coordinates 118-159
MVVMSRVSFYSSFLLLLLEVVVASSEFDDEGRTSFSPTTAIIMIVLVSVFFALGCISVYMRRCLQHALGMDSGGGPGNWLNVRQTTEPGLDASVIETFPTFPYSTVKTLRIGKEALECPVCLNEFEDDETLRLIPQCCHVFHPGCIDAWLRSQTTCPLCRANLVPVPGESVSSEIPGLARETGQNSLRTPIDDNRKRVLTSPDERLIDSVAWTGNQSMPRKSMSTGWKLAELYSPASSPGQPEENLDRYTLRLPQEIHDQLVNSSLGKQGSKGQLALPQERSSVRGFRTGSLGTEKNYFYFERFDQDGRLDRRPFSITPPYHTRSIQSPDEIINASGNYQDRAGAPKGLLLAIRSPFDRLFTGKKNAGERSYLQSGDASPV

SEQ ID NO: 1287 - DNA, 1071 bp, Arabidopsis thaliana
  G910,family:Z-CO-like
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattctggtaagaatcagccttgtgttgtccgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagcttaa

SEQ ID NO: 1288 - protein, 356 aa, Arabidopsis thaliana
  G910,Z-CO-like domain coordinates 14-37,77-103
MLCIIIIENMERVCEFCKAYRAVVYCIADTANLCLTCDAKVHSANSLSGRHLRTVLCDSGKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 1289 - DNA, 1296 bp, Arabidopsis thaliana
  G920,family:WRKY
aaaaaatctattttcttctctttccactatattacaacatttcttcattctcaaatcatcatactaaaaacctaaaaaaagttacatattcattgtatctttgtgagaaaaaaatggattcgaatagtaacaacacgaaatccataaagagaaaagttgtcgaccaacttgtcgaaggctatgaattcgctactcagcttcagcttctcctttctcatcaacactctaaccagtaccacatcgatgagacccgtcttgtttccgggtcgggttcagtttccggtggtccagatcccgttgatgagctcatgtctaagatcttgggatctttccataaaactatatcggttcttgattcttttgatcccgtcgccgtctctgtccccatcgccgtcgagggttcatggaatgcttcatgtggggatgattcggcgactccggtgagttgcaacggtggagattccggtgagagtaagaagaagagattaggggttggtaagggtaaaagaggatgctacactagaaagacgagatcacatacaaggatcgtggaagctaaaagttctgaagacagatatgcttggaggaaatatggacaaaaggagattcttaataccacattcccaagaagttactttagatgcacacacaagccaacgcaaggatgcaaagcaacaaagcaagttcagaaacaggatcaagattctgagatgttccaaatcacatacattggctaccacacatgcactgccaatgaccaaacgcacgcgaagaccgagccttttgatcaagaaatcattatggattcggaaaagacattggctgctagcactgctcagaaccatgtcaatgctatggtgcaagagcaagagaacaacaccagcagtgtgacagcaatagacgcaggcatggttaaggaggaacaaaataacaatggtgatcagagtaaagattattatgagggctcttcgacaggtgaggacttgtcattggtttggcaagagacgatgatgtttgatgatcatcaaaatcactactattgtggtgaaaccagtactacttctcatcaatttggtttcatcgacaacgatgatcagttttcctccttcttcgactcatattgtgctgattatgaaagaacaagtgctatgtgaacatccaaatctggaatgatgaatcagcactaggtcttctctttgagtatgtctagtttaatgtaatatttttgttgtatgtttgataaaaacaccatatatacttctctttttacaccaaaaaaaaaaaaaaaaaaaaaaa

SEQ ID NO: 1290 - protein, 346 aa, Arabidopsis thaliana
  G920,WRKY domain coordinates 152-211
MDSNSNNTKSIKRKVVDQLVEGYEFATQLQLLLSHQHSNQYHIDETRLVSGSGSVSGGPDPVDELMSKILGSFHKTISVLDSFDPVAVSVPIAVEGSWNASCGDDSATPVSCNGGDSGESKKKRLGVGKGKRGCYTRKTRSHTRIVEAKSSEDRYAWRKYGQKEILNTTFPRSYFRCTHKPTQGCKATKQVQKQDQDSEMFQITYIGYHTCTANDQTHAKTEPFDQEIIMDSEKTLAASTAQNHVNAMVQEQENNTSSVTAIDAGMVKEEQNNNGDQSKDYYEGSSTGEDLSLVWQETMMFDDHQNHYYCGETSTTSHQFGFIDNDDQFSSFFDSYCADYERTSAM

SEQ ID NO: 1291 - DNA, 1130 bp, Arabidopsis thaliana
  misc_feature (1100)..(1100): n is a, c, g, or t
  G921,family:WRKY
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 1292 - protein, 302 aa, Arabidopsis thaliana
  G921,WRKY domain coordinates 146-203
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 1293 - DNA, 1385 bp, Arabidopsis thaliana
  G927,family:CAAT
ggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgtttctcaaacaactgtaacaacttttaagttatgtggtttatgtaacatatttaagacctgtgtttttgtataaaaaaaaaa

SEQ ID NO: 1294 - protein, 295 aa, Arabidopsis thaliana
  G927,CAAT domain coordinates 136-199
MAMQTVREGLFSAPQTSWWTAFGSQPLAPESLAGDSDSFAGVKVGSVGETRQRVDKQSNSATHLAFSLGDVKSPRLVPKPHGATFSMQSPCLELGFSQPPIYTKYPYGEQQYYGVVSAYGSQSRVMLPLNMETEDSTIYVNSKQYHGIIRRRQSRAKAAAVLDQKKLSSRCRKPYMHHSRHLHALRRPRGSGGRFLNTKSQNLENSGTNAKKGDGSMQIQSQPKPQQSNSQNSEVVHPENGTMNLSNGLNVSGSEVTSMNYFLSSPVHSLGGMVMPSKWIAAAAAMDNGCCNFKT

SEQ ID NO: 1295 - DNA, 953 bp, Arabidopsis thaliana
  G929,family:CAAT
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 1296 - protein, 198 aa, Arabidopsis thaliana
  G929,CAAT domain coordinates 98-157
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 1297 - DNA, 1860 bp, Arabidopsis thaliana
  G934,family:ARF
atggaaagtggcaacgttgtgaatgcacaacctgaattatcaggcataattgatggatccaagagctatgtttacgagcagttatggaaactctgtgcgggacctttgtgtgatattccaaaacttggagaaaaggtttattactttcctcaaggtcacatagagcttgtgagttctctctctctctctctccctctcttttctttctctctccatctcttctctctctctcttctctctctctctgttgagacatctacaagagaagagttgaatgagttacaaccaatttgtgatcttccttctaagcttcaatgtcgtgttattgctattcatcttaaggtggaaaacaatagtgatgagacttatgctgagatcactttgatgccagatacaactcaagttgtaatccctactcagaatgaaaatcaatttagaccattagttaattcctttacgaaggttttaacggcctcagatacaagcgctcatggtggattctttgtaccgaaaaaacatgccattgaatgtctcccttcgctggatatgtctcaacctttacctgcacaagaacttcttgctatagatctccatggtaatcaatggagattcaaccacaactatagaggtacaccgcaaagacatttgttaacaactggttggaatgcattcacaacatcaaaaaaattggttgcaggggatgtcatcgtattcgttaggggagagactggagagttacgagttggtatcagacgagcaagacatcaacaagggaatataccttcatcaatagtatcaatagattgtatgagacatggggtagttgcttccgcaaagcatgcttttgataaccaatgtatgttcactgtggtttacaagccaaggtcaagtaaatttattgtcagttacgacaaattcttggacgctgtgaacaataagttcaatgtcggttcaagatttacaatgcggttagagggtgatgatttctctgaaagaagatgttttgggacaattattggagttagtgatttctctcctcattggaaatgttcagagtggcgcagcttagaagtgcagtgggatgaatttacatcatttccgggacctaaaaaagtgtcaccctgggacatcgaacatttaatgcctgcaataaatgttccgcgatcatttttgctcaagaacaagcgtttacgagaagttaatgaaatcggttcttcatcatcacatctcttacctcctatattgacacaaggacaagaaaatgaacaactaagtgttgcctctccgatgaatatttctcttcgttatcgtgatgcaactgaagatgctatgaatccttctaaattgctaatgagctaccctgtccaaccaatgcccaaactaaattacaataaccaaatggttacagaaatggaagaaaatataacaaccaagacaggcactaattttaggctgtttggagtcactctggacactcctccggtgatcaaagatcccattgaagaaattggctcggagatttcgaaacttactgaaggaaaaaagtttggtctaagccaaactttaagatcaccaacagagatccaaaacaagcagttcagttctagtagaacttgtaccaaagttcaaatgcaaggtgtaacaataggaagagctgtggatttaagtgttcttaatggatatgatcagctaatactagaattggagaagctctttgatatcaaaggtcaattgcaaactcgcaaccaatgggaaatagctttcacagatagtgacgaagataagatgcttgttggagacgatccatggcctgaattctgcaacatggtgaagaagatattcattcaaaagaggaggtaa

SEQ ID NO: 1298 - protein, 619 aa, Arabidopsis thaliana
  G934,ARF domain coordinates NA
MESGNVVNAQPELSGIIDGSKSYVYEQLWKLCAGPLCDIPKLGEKVYYFPQGHIELVSSLSLSLPLFSFSLHLFSLSLLSLSVETSTREELNELQPICDLPSKLQCRVIAIHLKVENNSDETYAEITLMPDTTQVVIPTQNENQFRPLVNSFTKVLTASDTSAHGGFFVPKKHAIECLPSLDMSQPLPAQELLAIDLHGNQWRFNHNYRGTPQRHLLTTGWNAFTTSKKLVAGDVIVFVRGETGELRVGIRRARHQQGNIPSSIVSIDCMRHGVVASAKHAFDNQCMFTVVYKPRSSKFIVSYDKFLDAVNNKFNVGSRFTMRLEGDDFSERRCFGTIIGVSDFSPHWKCSEWRSLEVQWDEFTSFPGPKKVSPWDIEHLMPAINVPRSFLLKNKRLREVNEIGSSSSHLLPPILTQGQENEQLSVASPMNISLRYRDATEDAMNPSKLLMSYPVQPMPKLNYNNQMVTEMEENITTKTGTNFRLFGVTLDTPPVIKDPIEEIGSEISKLTEGKKFGLSQTLRSPTEIQNKQFSSSRTCTKVQMQGVTIGRAVDLSVLNGYDQLILELEKLFDIKGQLQTRNQWEIAFTDSDEDKMLVGDDPWPEFCNMVKKIFIQKRR

SEQ ID NO: 1299 - DNA, 1250 bp, Arabidopsis thaliana
  G936,family:GARP
aagtgtatcttgatctagggttcacagacaaaatctccatgctttgaactaagcagaattcatctggtcttttatctctttcatatcaaaccaaaggattgatctatccatatcgtccaaaacctatatctagctaagcctagaacttctctatcgtttaccactttctttctatatttcttctgaatttgtaacatcagaagtaataatgattccaagtatggagggaggcgggaagactaacagagaagaagaggaggaggaagaggaagaagaagaagaaggtgaagagagtaaggtttcaagcaatagtacagtggaagagagcgacaagaagactaaggttaggccttatgtgagatctaaagtccctcgactccggtggactcctgatcttcatcttcgctttgtccgcgccgttgagaggcttggaggtcaagaaagagcaactccaaagttggttcgtcagatgatgaacatcaaagggcttagtattgctcatgtcaagagccatctacagatgtacagaagcaagaagatagatgatcaaggtcaagctatagctggtcacaaacatctcttcgagacttccacagatcgaaatatttataaactaagtcagctaccgatgttccgaggctataatcataaccatgattctccattcagatatggaagtaaaatttcaaatgcttctttgtggaactctagctctcaaggaacagaaaggagtttgatagaccaaattaggcccggtttaatccgcaacgcgtcggttagcaataacatccgtggtagtgattattggactaacaacaagtctttccaaaacatctactcttcttcaatttctaatcactttccgaaactacgacacgatcatcacgaacggaccaattcagtcacattcaacagcattcaaggacactcaagaacttttcaaaagttccataacggtgttgaggagaacactaatcattcttattgtagcaagacaaatggcaaaagagacgcaagtaggagcattgatcttgatctatctcttaagctaagacaaccggagaagacaattttggaagagacagaaacagcagcaacaacaacggatcaaacgttgtccttgtcgctatgtccagggtcgtcttcgtggaaaaagagccgactgatgaaagatgaagaggatcggacggttaagattggtcaggagagtactctggatctgactctatgaattatatttaagaatgaga

SEQ ID NO: 1300 - protein, 340 aa, Arabidopsis thaliana
  G936,GARP domain coordinates 59-107
MIPSMEGGGKTNREEEEEEEEEEEEGEESKVSSNSTVEESDKKTKVRPYVRSKVPRLRWTPDLHLRFVRAVERLGGQERATPKLVRQMMNIKGLSIAHVKSHLQMYRSKKIDDQGQAIAGHKHLFETSTDRNIYKLSQLPMFRGYNHNHDSPFRYGSKISNASLWNSSSQGTERSLIDQIRPGLIRNASVSNNIRGSDYWTNNKSFQNIYSSSISNHFPKLRHDHHERTNSVTFNSIQGHSRTFQKFHNGVEENTNHSYCSKTNGKRDASRSIDLDLSLKLRQPEKTILEETETAATTTDQTLSLSLCPGSSSWKKSRLMKDEEDRTVKIGQESTLDLTL

SEQ ID NO: 1301 - DNA, 1199 bp, Arabidopsis thaliana
  G937,family:GARP
tggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcaga

SEQ ID NO: 1302 - protein, 333 aa, Arabidopsis thaliana
  G937,GARP domain coordinates 197-246
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 1303 - DNA, 1755 bp, Arabidopsis thaliana
  G938,family:EIL
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 1304 - protein, 584 aa, Arabidopsis thaliana
  G938,EIL domain coordinates 96-104
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 1305 - DNA, 1722 bp, Arabidopsis thaliana
  G939,family:EIL
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatgttttctagtctttatagctttgtctcttgcttattctctcattaaacacagtttttgatctctccatttcatagcccatgtagcaatggagaagattaggtttcataataagttaataaccaaattcaaa

SEQ ID NO: 1306 - protein, 518 aa, Arabidopsis thaliana
  G939,EIL domain coordinates 97-106
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 1307 - DNA, 2310 bp, Arabidopsis thaliana
  G941,family:EIL
tcttcttcttcttcctcttcctcatctcgtatctctaacttttgtcgaagttcttttgatgaaactagggtttattatcttctccttctttttcccatcaccatagaaaaggcagagacctttttcttcatcatttttattctccttcttcttctgctgttcatttctccaggttacaatgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaaagtcttggtagtagatttcatcttctcttatttttatcttttgtgttcttacattcactcaaccatgtaatattttttcctgggtctctctgtctctatcgcttgttatgatgtgtctgtaagagtctctaaaaactctctgttactgtgtgtctttgtctcggcttggtgaatctctctgtcatcatcagcttttagttacacacccgacttggggatgaacgaacactaaatgtaagttttca

SEQ ID NO: 1308 - protein, 628 aa, Arabidopsis thaliana
  G941,EIL domain coordinates 95-103
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 1309 - DNA, 1095 bp, Arabidopsis thaliana
  G961,family:NAC
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataa

SEQ ID NO: 1310 - protein, 364 aa, Arabidopsis thaliana
  G961,NAC domain coordinates 12-180
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNGSG

SEQ ID NO: 1311 - DNA, 1444 bp, Arabidopsis thaliana
  G962,family:NAC
cgtcgactctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 1312 - protein, 414 aa, Arabidopsis thaliana
  G962,NAC domain coordinates 53-175
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 1313 - DNA, 897 bp, Arabidopsis thaliana
  G963,family:NAC
atgagtttgcctccaggattcaggtttcatcccactgatgaagaactggtggcttactatcttgataggaaggtcaacggccaagccattgagctcgagatcatcccagaagttgatctttataaatgcgagccatgggacttgcctgaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttga

SEQ ID NO: 1314 - protein, 298 aa, Arabidopsis thaliana
  G963,NAC domain coordinates NA
MSLPPGFRFHPTDEELVAYYLDRKVNGQAIELEIIPEVDLYKCEPWDLPEKSFLPGNDMEWYFYSTRDKKYPNGSRTNRATRAGYWKATGKDRTVESKKMKMGMKKTLVYYRGRAPHGLRTNWVMHEYRLTHAPSSSLKESYALCRVFKKNIQIPKRKGEEEEAEEESTSVGKEEEEEKEKKWRKCDGNYIEDESLKRASAETSSSELTQGVLLDEANSSSIFALHFSSSLLDDHDHLFSNYSHQLPYHPPLQLQDFPQLSMNEAEIMSIQQDFQCRDSMNGTLDEIFSSSATFPASL

SEQ ID NO: 1315 - DNA, 768 bp, Arabidopsis thaliana
  G975,family:AP2
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 1316 - protein, 199 aa, Arabidopsis thaliana
  G975,AP2 domain coordinates 4-71
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 1317 - DNA, 963 bp, Arabidopsis thaliana
  G976,family:AP2
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatcttttttggatcctttgttcacgtttatgctagtcatctttgtttctttatcctatgattgttagagatgatttgttaaatatataatcgtaatgattttcacttttttttattcaaaaaaaaaaa

SEQ ID NO: 1318 - protein, 248 aa, Arabidopsis thaliana
  G976,AP2 domain coordinates 87-153
MADPNNPITEPKAIIQSSTSSSVTIVPVPTCGDSLSDSATCENPCPLDTITTTTTTVCFAAPSSTASGNDINTLMATDTDISRRKKNPVYRGIRCRSGKWVSEIREPKKTTRVWLGTYPTPEMAAAAYDVAALALKGGDTLLNFPDSLGSYPIPLSSSAAHIRCAAAAAAATRGAAGAAVKVGQKKEDKVYDTAESSTMGFVDEEELLNMPGLLADMAKGMMVAPPWMGSPPSDDSPENSDGESLWSY

SEQ ID NO: 1319 - DNA, 1530 bp, Arabidopsis thaliana
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
  G979,family:AP2
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 1320 - protein, 430 aa, Arabidopsis thaliana
  G979,AP2 domain coordinates 63-139,165-233
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 1321 - DNA, 1742 bp, Arabidopsis thaliana
  G988,family:SCR
aaaataatatttattattgccattgaaaaagactcatttgatcgagagagaaaaagaatcatttgaaccaaaagcatctttttctatcttttcaaatgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatgatccaaagagaaggacaaaaaaacctatatatctaggtatatagtagacaaaaaaaaagatcgataatttttggtgttagggcaaaaaatgattaagcagatgatggaagaggacgatggctccggcgaagattgtcgacgccggcggattcttgggatgtgtgtctttttgtttcttgggaagctcaaacaaagagacaacctaatcttttgtgtttttaacctactaatatttactaatatctatattttttttgtcaaactcaatcttaggtgtatcgttttgacatatataatcccattctgtctc

SEQ ID NO: 1322 - protein, 445 aa, Arabidopsis thaliana
  G988,SCR domain coordinates 150-217,277-366,371-444
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 1323 - DNA, 789 bp, Arabidopsis thaliana
  G991,family:IAA
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 1324 - protein, 175 aa, Arabidopsis thaliana
  G991,IAA domain coordinates 7-14,48-59,82-115,128-164
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 1325 - DNA, 1239 bp, Arabidopsis thaliana
  G993,family:AP2
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 1326 - protein, 361 aa, Arabidopsis thaliana
  G993,AP2 domain coordinates 69-134,191-290
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 1327 - DNA, 513 bp, Arabidopsis thaliana
  G997,family:MYB-related
tcgacccacgcgtccgatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaaaaaaaaaaa

SEQ ID NO: 1328 - protein, 77 aa, Arabidopsis thaliana
  G997,MYB-related domain coordinates 9-59
MASSSMSTSSWTAREDKQFEMALAKFDKDTPDRWQKIARAVGGKSTEEVKRHYELLLRDVNDIESGRYPQPRYRNTN

SEQ ID NO: 1329 - DNA, 924 bp, Arabidopsis thaliana
  G999,family:MYB-(R1)R2R3
atggtgagatcttgttcttcaaaatcaaagaatccttggacaaacgaagaagacacaacccaaaagtttgtgtttgcgtctgcgtccaaaaacggatgtgcagctcctaagaaaataggacttaggagatgtggaaagagttgcagagtgagaaagactgatcattcaggaaccaaacatgagagcttcacttctgaagacgaagatctgatcatcaagatgcacgcagcaatgggaagcagatggcaacttattgcacaacatttaccaggaaagacagaagaagaagtgaagatgttttggaacacaaaactgaagaagaaactgtcggaaatggggatagatcatgtcactcaccgtcccttttctcacgtacttgctgaatacggcaacatcaatggtggtggaaacctaaaccctaatccctcgaaccaagccggatctcttggacgcaatcactcgctcaatgatgatggtcatcaacaacaacctaatgattcaggagatctcatgtttcatttacaagcaatcaagcttatgacagattcatcgaaccaagtcaagcctgagtctacgtttgtgtacgcctcttcgtcttcttctaactcgtctcctccattgttctcttcaacttgttctaccatagctcaggagaattcagaggttaacttcacttggtctgacttccttcttgaccaagaaaccttccatgaaaaccaacagaatcatcctcaagaactagacagcttgtttgggaacgacttctccgaggtaacagcagctacaatggctaacacatcaaccgtaccatctcagatcgaagaagaatctttgagcaatgggttcgttgaatcgattatcgctaaagaaaaggagtttttcttgggatttccgagctatctggaacaacctttccacttttag

SEQ ID NO: 1330 - protein, 307 aa, Arabidopsis thaliana
  G999,MYB-(R1)R2R3 domain coordinates 28-363
MVRSCSSKSKNPWTNEEDTTQKFVFASASKNGCAAPKKIGLRRCGKSCRVRKTDHSGTKHESFTSEDEDLIIKMHAAMGSRWQLIAQHLPGKTEEEVKMFWNTKLKKKLSEMGIDHVTHRPFSHVLAEYGNINGGGNLNPNPSNQAGSLGRNHSLNDDGHQQQPNDSGDLMFHLQAIKLMTDSSNQVKPESTFVYASSSSSNSSPPLFSSTCSTIAQENSEVNFTWSDFLLDQETFHENQQNHPQELDSLFGNDFSEVTAATMANTSTVPSQIEEESLSNGFVESIIAKEKEFFLGFPSYLEQPFHF

SEQ ID NO: 1331 - DNA, 583 bp, Arabidopsis thaliana
  G10,family:AP2
ggtgattcaatacaaacgaaaacaagagtttcctatggtgaaagaaggaatggtcatgaccgagaagccaaagaggaatctcataagctctaatgagaagcgatacaaaggaataaggatgaggaagtggggcaagtgggtggctgagataagagagcctaataaacgatcacggatctggcttggttcatacaaaaccgccgttgccgcggcacgggcctacgataccgctgtgttttacttacgtggtccttcggcgagactcaatttccctgaagaggtctttaaggatggaaacggcggtgaaggcttaggaggagatatgtctccgacgttgatacggaagaaggcggctgaggtgggagctagagtcgacgcagagttgcggttagagaataggatggttgagaacttagacatgaataagttgccggaggcatatggattgtaatttatagtttggtagtttataggttggagattgcccggagacagagtcaaacagaggttctctgactcatatgaggcataatatagttaatatagtaatttttgttttgagcatagtaattatgtcataacc

SEQ ID NO: 1332 - protein, 138 aa, Arabidopsis thaliana
  G10,AP2 domain coordinates 21-88
MVKEGMVMTEKPKRNLISSNEKRYKGIRMRKWGKWVAEIREPNKRSRIWLGSYKTAVAAARAYDTAVFYLRGPSARLNFPEEVFKDGNGGEGLGGDMSPTLIRKKAAEVGARVDAELRLENRMVENLDMNKLPEAYGL

SEQ ID NO: 1333 - DNA, 1368 bp, Arabidopsis thaliana
  G1010,family:ABI3/VP-1
attcttcttctaaaaaatcttgacaactttttgtttttgttttctttctctgaattttttaaaagagagagagctatgtagctatgaaacagtaagagatatagatatagagagacagagaaagatgatgatcagtgaagttaggctaaacccactttctatttatgtataattaggtcaatcacatcaccaatctcctcctccaattctcctcctctccttccaaattctagggttttgcttgtatctcaccccctttctcaattccctagggaaactgtgaatttcatcaaattccattattttttggtcacacccttaaagagatctgagagttctaaagatgatgacagatttatctctcacgagagatgaagatgaagaagaagcaaagcccttagcagaagaagaaggagcgcgtgaagtagcagacagagagcacatgttcgacaaagttgtgactccaagtgatgtcggaaaactaaaccgacttgtgatcccaaagcaacacgcagagagattcttccctttagattcatcttcaaacgagaaaggtttgcttttaaacttcgaagatctcactggcaaatcttggaggttccgttactcttactggaacagtagtcaaagctatgtcatgactaaaggttggagcagattcgttaaagacaaaaagcttgacgccggagatattgtctctttccaaagatgtgtcggagattcaggaagagatagccgtttgtttattgattggaggagaagacctaaagtccctgaccatcctcatttcgccgccggagctatgttccctaggttttacagctttccttcgaccaattacagtctttataatcatcagcagcaacgtcatcatcacagtggtggtggttataattatcatcaaattccgagagaatttggttatggttacttcgttaggtcagtggatcagaggaacaatcctgcggctgcggtggctgatccgttggtgattgaatctgtgccggtgatgatgcacgggagagctaatcaggaacttgttggaacggccgggaagagactgaggctttttggagttgatatggaatgcggcgagagcggaatgaccaacagtacggaggaggaatcatcatcttccggtggaagtttgccacgtggaggcggtggtggtgcttcatcttcctctttctttcagctgagacttggaagcagcagtgaagatgatcacttcactaagaaaggaaagtcttcattgtcttttgatttggatcaataataatgatgatgatgaaattagttggtattttaagaaaaaaaacatacatatataattctatatatatgacaacataatgcattgatttcctt

SEQ ID NO: 1334 - protein, 310 aa, Arabidopsis thaliana
  G1010,ABI3/VP-1 domain coordinates 33-122
MMTDLSLTRDEDEEEAKPLAEEEGAREVADREHMFDKVVTPSDVGKLNRLVIPKQHAERFFPLDSSSNEKGLLLNFEDLTGKSWRFRYSYWNSSQSYVMTKGWSRFVKDKKLDAGDIVSFQRCVGDSGRDSRLFIDWRRRPKVPDHPHFAAGAMFPRFYSFPSTNYSLYNHQQQRHHHSGGGYNYHQIPREFGYGYFVRSVDQRNNPAAAVADPLVIESVPVMMHGRANQELVGTAGKRLRLFGVDMECGESGMTNSTEEESSSSGGSLPRGGGGGASSSSFFQLRLGSSSEDDHFTKKGKSSLSFDLDQ

SEQ ID NO: 1335 - DNA, 803 bp, Arabidopsis thaliana
  G1011,family:MADS
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatagtaaaaaaaaaaaaaaaaaaaaaaaa

SEQ ID NO: 1336 - protein, 210 aa, Arabidopsis thaliana
  G1011,MADS domain coordinates 2-57
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 1337 - DNA, 805 bp, Arabidopsis thaliana
  G1029,family:HMG
accgaagatattttacaagcctttctccactaagcccttctctcttcttctcttggcctctcacttgaatctcccacaaagcgatcaatcacaaattccttcttctctctctctcttttcgtccctaagaatcaattatgaaaggagctaaatcaaagactgaaaccaggagctccaagctctctgtgaccaagaagccggctaaaggagcagggcgtggcaaagctgctgctaaggaccccaacaaaccaaagaggccagccagtgctttcttcgttttcatggaagatttccgtgagactttcaagaaggaaaaccccaagaacaagtctgtagctactgttggaaaagctgctggagacaagtggaagtccttgtctgattctgagaaagctccttatgttgctaaggctgagaaacgcaaggttgaatatgagaagaacattaaagcttacaacaagaaactggaggaaggtccaaaagaagatgaggaatctgacaagtcagtgtcagaggtcaatgacgaggatgatgctgaggatggtagtgaagaggaggaggacgatgactaagaagctgaatgttggtagcattagtatagatggctgcaaaaatctctctgtttttatctttacttgaaatgttaacggggctgattaaaatgggtctttctttttatctttttatatttccacaatctctcactaaagccctctgaatggagaaagtgaattgtagaatgtttagatggtgaaagagagacttgcagctctgtactctttgctttataaaacgatttagtttt

SEQ ID NO: 1338 - protein, 144 aa, Arabidopsis thaliana
  G1029,HMG domain coordinates 34-106
MKGAKSKTETRSSKLSVTKKPAKGAGRGKAAAKDPNKPKRPASAFFVFMEDFRETFKKENPKNKSVATVGKAAGDKWKSLSDSEKAPYVAKAEKRKVEYEKNIKAYNKKLEEGPKEDEESDKSVSEVNDEDDAEDGSEEEEDDD

SEQ ID NO: 1339 - DNA, 903 bp, Arabidopsis thaliana
  G1035,family:bZIP
ccataataatatattaaaactatatactataatctttttacataataaactttgggtcctgcgtcttaatcatagtacttaattttctctgtgtgttttaatatgaataataaaactgaaatgggatcttccacaagtggaaattgctcgtcggtttcaaccactggtttagctaactccggttcagaatctgatctccggcaacgtgatctaatcgacgagcggaagagaaagaggaaacagtcgaacagagaatctgcgaggaggtcgaggatgaggaagcagaagcatttggatgatctcactgctcaggtgactcatctacgtaaagaaaacgctcagatcgtcgccggaatcgccgtcacgacgcagcactacgtcactatcgaggcggagaacgacattctcagagctcaggttcttgaacttaaccaccgtctccaatctcttaacgagatcgttgatttcgtcgaatcttcttcttcaggattcggtatggagaccggtcagggattattcgacggtggattattcgacggcgtgatgaatcctatgaatctagggttttataatcaaccaatcatggcttctgcttctactgctggtgatgttttcaactgttagaaaacttcacatcattatcatcgtgagtgagactaatcatcgcagcaggggtaaaactgtaatttttcttataaattatgtgatgatgctttgtttctttattttataagatggttaattagtgtttaaaactgattgtaatgatagacagtgtaagaaatgtgtgatatcatggagatggtgatgtgagtttggtacaaatattttaagatcttttctttctatatattaaaagtgaagaaataatattttgtcattttcttaaaaaaaaaaaaaaaa

SEQ ID NO: 1340 - protein, 173 aa, Arabidopsis thaliana
  G1035,bZIP domain coordinates 39-91
MNNKTEMGSSTSGNCSSVSTTGLANSGSESDLRQRDLIDERKRKRKQSNRESARRSRMRKQKHLDDLTAQVTHLRKENAQIVAGIAVTTQHYVTIEAENDILRAQVLELNHRLQSLNEIVDFVESSSSGFGMETGQGLFDGGLFDGVMNPMNLGFYNQPIMASASTAGDVFNC

SEQ ID NO: 1341 - DNA, 1722 bp, Arabidopsis thaliana
  G1037,family:GARP
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 1342 - protein, 573 aa, Arabidopsis thaliana
  G1037,GARP domain coordinates 11-134,200-248
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 1343 - DNA, 1057 bp, Arabidopsis thaliana
  G1040,family:GARP
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 1344 - protein, 270 aa, Arabidopsis thaliana
  G1040,GARP domain coordinates 109-158
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 1345 - DNA, 1660 bp, Arabidopsis thaliana
  G1041,family:GARP
ctaaagatccacctcgaacttctctccatctttctcaatcatcatctaattctcagattccgtttccttcttcctttttcctcttcctcttcaagccacaaagactcataaaaatccaacctttttctcatttcctctgttaaatttttcctgaaaagtttattcctttttctacagatcgaatttcgtagttctcacctcactgaatctgttactttctctataatctaaatcttcaaaaatgtttctggttttgtgaaatcaacacttaaaaactcgagcttttacctcctctgttttttcaaagataaaaatgagagaagacgattcagactggttcgcaagatgggaagaagaacttccatcaccagaagagctcatgccaatatcacaatctctaatctcacccgatctagctctagccttcgatatacgaaccccaaatcacggaaacggaaactcaaaccaacctcatcatcatcatcatcaccaaaccacacctcctacaccgtctcagcttcagcttccatcttctcaagccaattcctcagccgaattcgctgcagattcagcagatctaggctccggaggagctgccggagacgaaccagctcggactttaaaacgacctcgtcttgtctggacaccgcagctgcataaacgtttcgttgatgctgttgcgcatttagggattaagaacgcagttcctaaaacgattatgcagcttatgagtgttgatggtttaactagagaaaacgttgcgagtcatttgcaaaagtatagactttatcttaagagaatgcaaggtttgtcttctggtggtggtgctggttcagatccagctactgatcgtcttttcgctagctctcctgttcctgctcactttcttcatcctaatcgtgttcccagttctgatcatttcatgccgtcttttgttcctattgctactcttcaacaacaacaacaaatggctgctgctgcggccgctgctgcagcagctaatcctcatttacaaccgcctcagttccaccgtcaaatcgcagctgcgcattttggttcaccgactaatggtggattcagttcaccgacgagtaatggacagtttggatcaccgactagtaatggatttggatcaccgacgactaatgggaagtttgatccttcgttcttggcggtgaggcaaacgcagcagcaaccaattcagagaatgtctacaccatcattgcatagtccagttagtaattacgttgaggatttggaatctgcaaacgctaatggagggagaactgtcttaactttattcccaactcgagacgattaaaaagtcattatctttccggttactagatgttcaaaatgtctctgcagtcatcaagaacatgagtcagctgatcgttcttgtgcatcggttttatccggtggcgtttactctgtgcagtcttatcagtttaacattgatacaatccagcgtcaatgtgtggtcaagttctgtatctgaagctcaagcaccttcaggtcaaggcttgtattaacccttgtagctttcttgtgtaagattaatgtaaagatgagtttacttttgaacgtacatccgtacgaacaaactcaagattggaaaaaagaatgaaaaaaacaaaaacttacttcacaatgttctttg

SEQ ID NO: 1346 - protein, 335 aa, Arabidopsis thaliana
  G1041,GARP domain coordinates NA
MREDDSDWFARWEEELPSPEELMPISQSLISPDLALAFDIRTPNHGNGNSNQPHHHHHHQTTPPTPSQLQLPSSQANSSAEFAADSADLGSGGAAGDEPARTLKRPRLVWTPQLHKRFVDAVAHLGIKNAVPKTIMQLMSVDGLTRENVASHLQKYRLYLKRMQGLSSGGGAGSDPATDRLFASSPVPAHFLHPNRVPSSDHFMPSFVPIATLQQQQQMAAAAAAAAAANPHLQPPQFHRQIAAAHFGSPTNGGFSSPTSNGQFGSPTSNGFGSPTTNGKFDPSFLAVRQTQQQPIQRMSTPSLHSPVSNYVEDLESANANGGRTVLTLFPTRDD

SEQ ID NO: 1347 - DNA, 715 bp, Arabidopsis thaliana
  G1047,family:bZIP
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagaaaaaaaaa

SEQ ID NO: 1348 - protein, 227 aa, Arabidopsis thaliana
  G1047,bZIP domain coordinates 129-180
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 1349 - DNA, 1766 bp, Arabidopsis thaliana
  G1050,family:bZIP
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 1350 - protein, 519 aa, Arabidopsis thaliana
  G1050,bZIP domain coordinates 372-425
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 1351 - DNA, 1421 bp, Arabidopsis thaliana
  G1058,family:bZIP
aaaagatttcgggtcgatgaacatggatgaactcctgaagagcatatggactgctgaggaagctcaggccatggccatgacttctgcgccagctgctacagcggtagcgcaacctggtgctggtatcccacccccaggtgggaatctccagaggcaaggttcgttgacgttgcctagaacaattagtcagaagactgttgatgaggtgtggaaatgtttgatcaccaaggatggtaatatggaaggtagcagcggaggcggtggtgagtcgaatgtgcctcctggaaggcaacagactttaggggaaatgacacttgaagaatttctgttccgtgctggggttgtaagagaagataactgtgttcaacagatgggtcaggtcaacggaaacaataacaatgggttttatggtaacagcactgctgctggcggcttaggttttggatttggtcagccaaatcaaaacagcataacattcaatggtactaatgattctatgatcttgaatcagccacctggtttagggctcaaaatgggtggaacaatgcagcagcaacaacaacaacagcagttgcttcagcagcaacaacagcagatgcagcagctgaatcagcctcatccacagcagcggctgcctcaaaccatttttcctaaacaagcaaacgtagcattttctgcgcctgtgaatataaccaacaagggttttgctggggctgcaaataattctatcaacaataataatggattagctagttacggaggaaccggggtcactgttgcagcaacttctccaggaacaagcagcgcagaaaataattctttatcaccagttccgtatgtgcttaatcgaggacgaagaagcaatacaggtctagagaaggttatcgagaggaggcaaaggagaatgatcaagaatcgggaatcagctgctagatcaagagctcgaaagcaggcttatacattggaactggaagccgaaattgaaaagctcaagaaaacgaatcaagaactgcagaaaaaacaggctgaaatggtggaaatgcagaagaatgagctgaaagaaacgtcgaagcgaccgtggggcagcaaaaggcaatgcttgagaaggacattaaccggaccatggtgaaggatgaagcaacaagaacggatgaaccagactcctagcttgggattaatgtaataggatagtgctacctgtacaggagattaagagaaattgagtgaaagatctaggttacagagtaggagagagttttcattatgaataaatgacattttgtgccctgacctttgttagtttaggtttagattatcctctgttattgacttattgtgctttctggttgttagggtttctaaaagacatagttgtttatatatatgtctgactttgtaaaaaaaaaaaaaaaaaaaaaaaa

SEQ ID NO: 1352 - protein, 370 aa, Arabidopsis thaliana
  G1058,bZIP domain coordinates 292-386
MNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPW

SEQ ID NO: 1353 - DNA, 1313 bp, Arabidopsis thaliana
  G1061,family:HLH/MYC
caaaaaaaagtgtagaagcagaagaaacccatcatcatcatgatgaactcttctcttctaactccttcttcttcatcttcttcccatatccaaactccatcaacaactttcgaccacgaagacttcctcgatcaaatcttttcctcggccccgtggccctccgtcgtcgatgatgctcatcctcttccctccgatggcttccacggccacgatgtcgactcaaggaatcagccgatcatgatgatgcctttgaatgatggctcctccgtccacggtctttataatggcttctccgtcgccggatctcttcctaactttcaaatccctcagggatcggagggaggattgatgaaccaacaaggacaaacgcaaacgcaaacgcaacctcaggcgagcgcgtctacagctactggcggtacggtggcggctccgccgcagagtaggactaaaatccgagctaggagaggtcaagcaactgatcctcatagtatcgccgaaaggttacgaagagagagaattgcggaaagaatgaaagctcttcaagaactcgttcctaacggcaataagacagacaaggcatcgatgctcgatgagatcatagattatgtcaagtttttacaactccaagtcaaggtactgagcatgagcagattgggaggtgctgcttccgtttcttctcaaatctccgaggctggtggatcccacgggaacgcatcctccgccatggtcggcggtagccagacggccggaaactccaacgacagcgttacaatgacggaacatcaagtggccaaactaatggaagaagacatgggctcggccatgcaatatcttcaagggaaaggtctttgtctcatgccaatctctttagccaccgccatctcaaccgccacgtgtcactcccgtaaccctttgatccctggagctgttgccgacgccggaggtccttcccctcccaatctttctgccatgaccatacagtcgacgagtacaaaaatgggtagcggtaatgggaaattaaacggtaacggcgtgaccgagaggtcgtcttctatcgccgttaaagaggccgtatccgtttcgaaagcgtgataacggccgtttacttttggggttaggcagagagataccaaaaacaaagagaaagtggggtgaagtgggagataaagtcaaagtctacgaagaatgaggttgaggttgtttgatgtgttctctcaacgaagccatatttttcgtagagttttggttcttttacctacgcactacaaaaccactcaagggacatttctttttcttttttaaatatatggtgc

SEQ ID NO: 1354 - protein, 350 aa, Arabidopsis thaliana
  G1061,HLH/MYC domain coordinates 141-198
MMNSSLLTPSSSSSSHIQTPSTTFDHEDFLDQIFSSAPWPSVVDDAHPLPSDGFHGHDVDSRNQPIMMMPLNDGSSVHGLYNGFSVAGSLPNFQIPQGSEGGLMNQQGQTQTQTQPQASASTATGGTVAAPPQSRTKIRARRGQATDPHSIAERLRRERIAERMKALQELVPNGNKTDKASMLDEIIDYVKFLQLQVKVLSMSRLGGAASVSSQISEAGGSHGNASSAMVGGSQTAGNSNDSVTMTEHQVAKLMEEDMGSAMQYLQGKGLCLMPISLATAISTATCHSRNPLIPGAVADAGGPSPPNLSAMTIQSTSTKMGSGNGKLNGNGVTERSSSIAVKEAVSVSKA

SEQ ID NO: 1355 - DNA, 1327 bp, Arabidopsis thaliana
  G1073,family:AT-hook
tcaccgacccagctctttcacatatgtagacctctctctctctaattattcagtaaggttttgttctctcttgtcgtcttcttgttttgtccgtagcattattaataatcaaactcagtctctgaaatactctcagtgacaaaccacttctgtcgacttttgtctttgtctctcactagctataaccaaaaaaatccaaaaacccaaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttttatttatttattttttgtttctcttaaaacttggtgtgtgaaaaaagaaaacgaacgcttaaatttcctttttctgtttgtttttatgaggcc

SEQ ID NO: 1356 - protein, 299 aa, Arabidopsis thaliana
  G1073,AT-hook domain coordinates 63-71,72-216
MSSYMHPLLGQELHLQRPEDSRTPPDQNNMELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 1357 - DNA, 1084 bp, Arabidopsis thaliana
  G1075,family:AT-hook
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 1358 - protein, 285 aa, Arabidopsis thaliana
  G1075,AT-hook domain coordinates 78-86,87-229
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 1359 - DNA, 1511 bp, Arabidopsis thaliana
  G1108,family:RING/C3H2C3
gtgtggtatgcgcaaagtggacaatacctagatgggtgtttctcttctgaaacaacaacatcgtattacaaatcaagctgatactttttctagattcatggaaagatcaccagagaataatctaagcagaaatgagcacatcatcattgacattccaagaaatgccgccattgcatcatcatcatcttctcatgatagaatctcaaatgttttggaacctttacaacatgaggaagagagaccttctactgtttctcccatggctgctcctcagccagctacagctacagcttcttcttcttcttctatgcgatcaaatcctagaagtgtccgtcgtagaagaagtcctttgaattctggcttatggatttctattgaactattcctcactgttggtcagatcattgcagctattgtcgttttgtctttgtcaaaacatgagcatcctcgtgctcctttgttcacttggattgttggttatgcgtgtggatgcgttgctacactcccgcttttgtactggagatattatcattcgaatcaggcttctgaacaggattctggtcagcaccgtcctaatcttaatgttgcagcaggaccattcgccttctcgatatccaggacatccgaagcagatggtcgacagaccaataccacctcttctcgtggtagtagatatcctgggtttataagtgctgccagacttaaagttatcgtggaatacttcaaaatggctctggattgcttctttgcggtgtggtttgtggtaggtaatgtatggatatttggagggcattcatctgctgccgaggctcctaacttgtacaggttatgtttagtgtttcttacctttagctgtattggctacgcgatgcccttcatcctctgtacaacaatatgttgctgcttgccttgcataatctcaattctcggatatagagaagatttaacgcaacctcgaggtgccacacctgagtcgattaatgcgttgccgactcataaatttaagttgaagaaaagcagaagtaatggcgatgacaatggttcaagtactagcgaaggtggagttgtggcggctggaacagataacgaacgagctatttcaggagaggacgcagtctgttgcatttgcttagcgaaatatgcgaataacgaggagttaagagagcttccatgctcacatttcttccacaaagagtgcgttgacaaatggctgaagatcaatgcctcttgccctctatgcaagagcgaagttggggagaagaactctgatttgactagccaagggatcttaacctcgctctcttctggggaaaacgataaccatcaacaacagcaacaacaacaacggagtgaacttagagttgagaatggtttggccaataatgttatctagatcttcgagatttgctctatgtccgagaaaacggcaaattagccgtttggcgatgttcctacacaaaatggggtttgcttctcattgctaagaaggtgaagaaagacacggcgaagat

SEQ ID NO: 1360 - protein, 453 aa, Arabidopsis thaliana
  G1108,RING/C3H2C3 domain coordinates 363-403
MGVSLLKQQHRITNQADTFSRFMERSPENNLSRNEHIIIDIPRNAAIASSSSSHDRISNVLEPLQHEEERPSTVSPMAAPQPATATASSSSSMRSNPRSVRRRRSPLNSGLWISIELFLTVGQIIAAIVVLSLSKHEHPRAPLFTWIVGYACGCVATLPLLYWRYYHSNQASEQDSGQHRPNLNVAAGPFAFSISRTSEADGRQTNTTSSRGSRYPGFISAARLKVIVEYFKMALDCFFAVWFVVGNVWIFGGHSSAAEAPNLYRLCLVFLTFSCIGYAMPFILCTTICCCLPCIISILGYREDLTQPRGATPESINALPTHKFKLKKSRSNGDDNGSSTSEGGVVAAGTDNERAISGEDAVCCICLAKYANNEELRELPCSHFFHKECVDKWLKINASCPLCKSEVGEKNSDLTSQGILTSLSSGENDNHQQQQQQQRSELRVENGLANNVI

SEQ ID NO: 1361 - DNA, 2910 bp, Arabidopsis thaliana
  G1149,family:PAZ
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 1362 - protein, 969 aa, Arabidopsis thaliana
  G1149,PAZ domain coordinates 870-880
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 1363 - DNA, 3147 bp, Arabidopsis thaliana
  G1152,family:PAZ
atggtgagaaagagaagaacggatgctccatctgaaggaggtgaaggctctgggtctcgtgaagctggtccagtctcaggtggtggacgtggttcacagcgaggtggtttccagcagggaggaggacaacaccaaggtggaaggggttatactcctcaacctcaacagggaggtcgtggtggtcgtggatatgggcaaccaccacaacagcaacaacagtatggaggaccacaagagtaccaaggaagaggaagaggaggacctcctcatcaaggaggtcgaggagggtatggcggtggccgtggaggtggaccttcttctggaccaccgcagagacaatcagttcccgagctgcatcaagctacctcacctacttatcaagcggtgtcttctcagcctacactgtctgaggtgagtcctacccaggtaccagaacctactgttctggctcagcaatttgaacaactctctgttgaacaaggagctcccagtcaggcaatccagcctataccttcttctagcaaggctttcaagtttccaatgaggcctggtaaaggacagagtggaaagcgttgcattgtgaaggctaaccatttctttgctgaactgcctgataaggatttgcaccattatgatgttaccattactccggaagttacatcaaggggtgtcaatcgtgctgtgatgaaacaacttgttgataattatcgtgattctcaccttggaagtcgtcttccagcgtatgatggtcgaaaaagtctttacactgctggtccacttccctttaactccaaggagttcagaatcaatcttcttgacgaagaagtaggggctggaggtcaaagacgagaaagggaatttaaagttgtgatcaagctagttgcacgtgctgatctgcatcacctaggaatgtttttggaggggaaacaatcagatgccccacaggaagctctgcaggttcttgacattgttcttcgtgagctgccgacctctaggtatattccggtgggccggtccttttattcccctgatataggaaaaaaacaatcattgggggatggcttggagagctggcgtggattctaccaaagcattcgtcctacacagatgggcttatcactcaatattgatatgtcatcgacagccttcatagaggcaaaccctgtgattcagtttgtctgtgatttgcttaaccgggatatttcttctcgacctttatctgatgctgatcgtgttaagataaaaaaggctcttagaggtgtcaaagttgaagtgactcatcgaggaaacatgcgccggaagtaccgcatttccggtttgactgctgtggccactcgggaattgacattcccagtagatgaaagaaatactcagaaatctgttgtagaatacttccacgaaacatatggttttcgcattcagcacactcaactaccatgcttgcaagttgggaattctaataggcctaattacttaccaatggaggtatgcaagattgttgaaggccagcggtattccaaaagattgaatgagagacagatcactgctttgctgaaggttacctgtcagcgcccgatagatcgagaaaaagatatcttacagacggtgcaactcaatgattatgctaaagataattatgctcaagagtttggcatcaaaataagtacttctctggcttctgttgaggctcgtatactgcctcctccatggcttaagtaccacgagtctggaagggaagggacttgtctgccacaagttggtcaatggaacatgatgaataagaaaatgatcaatggtggaacggtgaataattggatctgcatcaacttttctaggcaagtgcaggacaatctagcgcgtacattttgtcaggaacttgctcaaatgtgttacgtatctggcatggcatttaatccggaaccagtcctcccaccagtcagtgctcgccctgagcaagtagagaaggtcttgaagactagatatcatgatgccacatcaaaactctcccaaggaaaagaaattgatctgcttattgtcattctgcccgataataatggatcattatacggtgatttgaaacgcatatgtgagactgaactcggcatagtctctcaatgttgcctgacaaagcatgtctttaagatgagcaaacaatacatggctaatgttgcgctgaagattaatgtgaaggttggaggaagaaacacagtgcttgttgatgctctatctaggcggattcctctagtcagtgatcgacccaccattatatttggtgctgatgttacccaccctcaccctggagaggattcaagcccatctattgctgctgttgtggcatctcaggattggcctgaaatcactaaatatgctggattagtttgcgctcaagcgcataggcaggagctcattcaggatctgttcaaagagtggaaggatcctcagaaaggtgtggtgactggtggcatgataaaggagttgctcatagccttccgtagatcaactgggcataaaccactaaggatcatcttctacagggatggagtcagtgagggacaattttaccaagttttgctctatgaacttgatgccatccgcaaggcctgtgcttcgctggaagcaggttatcaaccaccagtgacatttgtggtggtgcagaagcgtcatcacacgaggctgtttgctcagaaccacaatgatcgccattcggtggacagaagtgggaatattttacctggcactgttgtggactctaaaatctgccaccctacagagtttgacttttacctctgtagtcatgctggtattcagggcacttctcgacctgctcattaccacgttctttgggatgagaacaactttactgcagatggacttcaatctctgaccaataacttatgttacacgtatgcaagatgcacacgctcagtttcaattgttccccctgcatattatgcacatctagcagcttttagggctcgattctacatggagccagagacatcagacagtggctcaatggctagtgggagcatggcacgtggaggtggaatggctggtagaagcacacgcgggcctaatgtcaatgctgcagtgaggccactcccagctctgaaagagaatgtgaagcgtgtcatgttctactgctga

SEQ ID NO: 1364 - protein, 1048 aa, Arabidopsis thaliana
  G1152,PAZ domain coordinates 937-947
MVRKRRTDAPSEGGEGSGSREAGPVSGGGRGSQRGGFQQGGGQHQGGRGYTPQPQQGGRGGRGYGQPPQQQQQYGGPQEYQGRGRGGPPHQGGRGGYGGGRGGGPSSGPPQRQSVPELHQATSPTYQAVSSQPTLSEVSPTQVPEPTVLAQQFEQLSVEQGAPSQAIQPIPSSSKAFKFPMRPGKGQSGKRCIVKANHFFAELPDKDLHHYDVTITPEVTSRGVNRAVMKQLVDNYRDSHLGSRLPAYDGRKSLYTAGPLPFNSKEFRINLLDEEVGAGGQRREREFKVVIKLVARADLHHLGMFLEGKQSDAPQEALQVLDIVLRELPTSRYIPVGRSFYSPDIGKKQSLGDGLESWRGFYQSIRPTQMGLSLNIDMSSTAFIEANPVIQFVCDLLNRDISSRPLSDADRVKIKKALRGVKVEVTHRGNMRRKYRISGLTAVATRELTFPVDERNTQKSVVEYFHETYGFRIQHTQLPCLQVGNSNRPNYLPMEVCKIVEGQRYSKRLNERQITALLKVTCQRPIDREKDILQTVQLNDYAKDNYAQEFGIKISTSLASVEARILPPPWLKYHESGREGTCLPQVGQWNMMNKKMINGGTVNNWICINFSRQVQDNLARTFCQELAQMCYVSGMAFNPEPVLPPVSARPEQVEKVLKTRYHDATSKLSQGKEIDLLIVILPDNNGSLYGDLKRICETELGIVSQCCLTKHVFKMSKQYMANVALKINVKVGGRNTVLVDALSRRIPLVSDRPTIIFGADVTHPHPGEDSSPSIAAVVASQDWPEITKYAGLVCAQAHRQELIQDLFKEWKDPQKGVVTGGMIKELLIAFRRSTGHKPLRIIFYRDGVSEGQFYQVLLYELDAIRKACASLEAGYQPPVTFVVVQKRHHTRLFAQNHNDRHSVDRSGNILPGTVVDSKICHPTEFDFYLCSHAGIQGTSRPAHYHVLWDENNFTADGLQSLTNNLCYTYARCTRSVSIVPPAYYAHLAAFRARFYMEPETSDSGSMASGSMARGGGMAGRSTRGPNVNAAVRPLPALKENVKRVMFYC

SEQ ID NO: 1365 - DNA, 1239 bp, Arabidopsis thaliana
  G1181,family:HS
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 1366 - protein, 299 aa, Arabidopsis thaliana
  G1181,HS domain coordinates 23-114
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 1367 - DNA, 1980 bp, Arabidopsis thaliana
  G1186,family:AKR
aagttgcaagtctttcatctctatgcacaaatggcgaaagagaacagtagtcatagccttgcagaagcaaagagaaagagactcacttggattctttgtgtaagtggactttgcatattgtcttatgttcttggatcttggcaaaccaacactgtcccaacttcttcctctgaggcttactcaagaatgggatgtgatgaaacatcaacaaccactcgggctcagactactcagactcaaacaaatccttcttctgacgatacttcttcctctttgtcttcctcagaaccagttgagttagatttcgaaagccatcacaaactcgagctgaagattacgaatcaaaccgtaaagtactttgagccatgtgacatgtctttgagtgagtacactccatgtgaagatcgagagagaggaagaagatttgataggaacatgatgaagtacagagagagacattgtccttctaaagatgagcttctttattgtctgattcctcctccaccaaactacaagattccattcaagtggcctcaaagtagagattatgcttggtacgacaacattccacacaaggagcttagtattgagaaagctatccagaactggattcaagtagaaggggaaagattcaggttccctggtggtggcacaatgtttccacgtggagctgatgcttacattgatgatattgctagactcattcctcttactgatggagccattagaacagctattgatacaggatgtggtgtggcgagttttggtgcatacttgttgaagagggatattgtggctatgtcatttgctccaagggacactcatgaagctcaagttcaatttgcgttggaacgtggagttcctgcgattatcgggattatgggatcaagaaggcttccttatccagctagagcttttgatcttgctcactgttctcgttgtttgattccttggtttcaaaatgatggtttgtacttgaccgaagtggaccgggttttaagaccgggcggttattggatcctttcgggtccaccgatcaactggaagaaatactggaaaggctgggaaagatcacaagaggatttgaagcaagagcaagattctatagaagatgcagcaagaagtctttgttggaagaaagttacagaaaagggtgatttatcaatttggcaaaagcctatcaatcacgttgagtgtaacaaactcaaacgagttcacaaaactcctcctctatgcagtaaatcagatttacccgattttgcttggtacaaagatttggaatcttgtgtaacaccattaccagaagcaaacagttcagacgaattcgcaggcggtgcattggaggattggccaaaccgagcttttgcggtgccacctaggataatcgggggaaccattccggacattaatgctgagaaattcagagaagacaatgaagtgtggaaggagagaatatcatattacaaacagataatgccagagctttcaagaggaagatttaggaacataatggacatgaatgcatacttgggaggatttgctgcggcaatgatgaaatatccatcttgggttatgaatgtggttcctgtggatgctgagaagcaaacgttaggggttatctttgaacgaggatttatagggacttatcaagattggtgtgaaggattctctacgtatccgagaacttatgatttgattcatgctggtggattgttcagcatttatgagaacaggtgtgatgttacattaatactacttgagatggatagaattttgagaccagaaggaaccgtggtgtttagagacactgtggaaatgttgacgaagatacaaagcataaccaatggaatgaggtggaagagtcggattttggatcatgagagaggtccttttaatcctgagaagatccttctcgctgtaaaatcctattggaccggtccttcttcttagctagttctagctttcttgaactctctactc

SEQ ID NO: 1368 - protein, 639 aa, Arabidopsis thaliana
  G1186,AKR domain coordinates 119-631
MAKENSSHSLAEAKRKRLTWILCVSGLCILSYVLGSWQTNTVPTSSSEAYSRMGCDETSTTTRAQTTQTQTNPSSDDTSSSLSSSEPVELDFESHHKLELKITNQTVKYFEPCDMSLSEYTPCEDRERGRRFDRNMMKYRERHCPSKDELLYCLIPPPPNYKIPFKWPQSRDYAWYDNIPHKELSIEKAIQNWIQVEGERFRFPGGGTMFPRGADAYIDDIARLIPLTDGAIRTAIDTGCGVASFGAYLLKRDIVAMSFAPRDTHEAQVQFALERGVPAIIGIMGSRRLPYPARAFDLAHCSRCLIPWFQNDGLYLTEVDRVLRPGGYWILSGPPINWKKYWKGWERSQEDLKQEQDSIEDAARSLCWKKVTEKGDLSIWQKPINHVECNKLKRVHKTPPLCSKSDLPDFAWYKDLESCVTPLPEANSSDEFAGGALEDWPNRAFAVPPRIIGGTIPDINAEKFREDNEVWKERISYYKQIMPELSRGRFRNIMDMNAYLGGFAAAMMKYPSWVMNVVPVDAEKQTLGVIFERGFIGTYQDWCEGFSTYPRTYDLIHAGGLFSIYENRCDVTLILLEMDRILRPEGTVVFRDTVEMLTKIQSITNGMRWKSRILDHERGPFNPEKILLAVKSYWTGPSS

SEQ ID NO: 1369 - DNA, 1071 bp, Arabidopsis thaliana
  G1197,family:GARP
cagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctaaaaaaaa

SEQ ID NO: 1370 - protein, 292 aa, Arabidopsis thaliana
  G1197,GARP domain coordinates NA
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 1371 - DNA, 831 bp, Arabidopsis thaliana
  G12,family:AP2
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 1372 - protein, 196 aa, Arabidopsis thaliana
  G12,AP2 domain coordinates 27-94
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 1373 - DNA, 1625 bp, Arabidopsis thaliana
  G1227,family:HLH/MYC
tcttccgtgtgttaacagaagtccccacaattgtctgtcttcgctgcgagacaaaactgccacagccaataatgtttctctgagggaccttgcttctgtcagagactcgctctctctctcctcttcttgctctgctcagctctctcaccaactcatcttcagtcctcaaacaaacatctgttctcatctttgttttctttcctttctttctcatatctcattttcaattttcccaatttctcttcaacatcttcatagcaatttaagaccactattccattataaagctaactgctttagaaactcctcacatttatttcttccccatcattgttttagagagggagaaagaaaaagagctcagctttctgatggagaggagtattcaaggacaaaacaagctctgttgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagaggggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatgc

SEQ ID NO: 1374 - protein, 359 aa, Arabidopsis thaliana
  G1227,HLH/MYC domain coordinates 175-234
MERSIQGQNKLCCLDQKVNVRRSLQVQETVEDHQSFALEEEEQQLSTPSLLQDTTIPFLQMLQQSEDPSPFLSFKDPSFLALLSLQTLEKPWELENYLPHEVPEFHSPIHSETNHYYHNPSLEGVNEAISNQELPFNPLENARSRRKRKNNNLASLMTREKRKRRRTKPTKNIEEIESQRMTHIAVERNRRRQMNVHLNSLRSIIPSSYIQRGDQASIVGGAIDFVKILEQQLQSLEAQKRSQQSDDNKEQIPEDNSLRNISSNKLRASNKEEQSSKLKIEATVIESHVNLKIQCTRKQGQLLRSIILLEKLRFTVLHLNITSPTNTSVSYSFNLKMEDECNLGSADEITAAIRQIFDS

SEQ ID NO: 1375 - DNA, 1264 bp, Arabidopsis thaliana
  G1232,family:Z-C4HC3
gctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatcttgtgaaagtctttggcttttgaagcaatactatggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctgaaagtgataataacattagagcctgtgaaagaggaaaacgttttcacagtttaagaagacagtacaagagtttagctgtgggaagaagaagaaacaaaaggcttctgattgcgtagttttaatgggattgagacagcttacagttagtaatgtctctttctcttttcttttctttttttttgctgttaatgttaaaatgttatgactaatttgtcttaagtttctgagaaaattctgtcttttaagcactctctagtctatgtcaagtggtttcttcttctcggtaaaaa

SEQ ID NO: 1376 - protein, 252 aa, Arabidopsis thaliana
  G1232,Z-C4HC3 domain coordinates 197-245
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 1377 - DNA, 838 bp, Arabidopsis thaliana
  G1241,family:MISC
tacccttcgaccaacgaagaaccctagaaatcgattaacaagatgaatagggaaaagttgatgaagatggctaacactgtccgcactggcggaaaggggacagtaagaagaaagaagaaggctgttcacaagaccactacaaccgatgacaagaggctccagagcactcttaagagagttggagtcaattccattcccgccattgaagaagttaacatttttaaggatgatgtagtcattcagttcattaaccctaaagttcaagcttcaattgctgctaacacatgggttgtgagtggtacaccacagacgaaaaaattgcaagacattcttcctcagattatcagccaacttggaccagataacttggacaacctgaagaagctagcagagcaattccagaaacaagctccaggtgcaggtgatgtcccagcaacaatccaagaagaggacgatgatgatgatgtcccagatcttgtagtgggagagactttcgagacccctgctactgaagaggctcccaaagctgctgcttcttagaggaggaggaagaagaaggagaagagctcacctgcaaaacccatcataaaaatgtttgtcgctcgacctcttctgagcactgtcagattcttgttttctctaatgcttgcgaacagaaagacttggttttattatcacttgatgctttttggtccgaacagcaattttccttttattaaggttagatcgctttttgtttaccacctgttcaaatgagtactactatgtcctgtcgcttcatacacttcttgcaacacagtcctttgttttgagtcaacgatgtcttgagatgaacaaa

SEQ ID NO: 1378 - protein, 165 aa, Arabidopsis thaliana
  G1241,MISC domain coordinates NA
MNREKLMKMANTVRTGGKGTVRRKKKAVHKTTTTDDKRLQSTLKRVGVNSIPAIEEVNIFKDDVVIQFINPKVQASIAANTWVVSGTPQTKKLQDILPQIISQLGPDNLDNLKKLAEQFQKQAPGAGDVPATIQEEDDDDDVPDLVVGETFETPATEEAPKAAAS

SEQ ID NO: 1379 - DNA, 2481 bp, Arabidopsis thaliana
  G1242,family:SWI/SNF
gcgccgagacttttcagcaccaactatcggcttcttatcacgggaaccccccttcagaataatctccatgaattgtgggcccttctcaattttcttctccctgaggtttttagttcagcagaaacttttgacgagtggtttcaaatttctggtgaaaacgaccagcaagaagttgttcaacaacttcacaaggttctgcgaccatttcttcttcggaggttaaaatcagatgtagagaaaggcttacctccaaaaaaggagacaatactcaaagttggcatgtctcaaatgcaaaaacagtactacaaggctttactgcagaaggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcggagaattagttagaagaagctccttagagacaaggatctaatattttgtacccgcaagcatcactgcattgtctccgacttctcttatttcttcaacgtgtattttactctattttgtttgtagaaatattcaccacattcctagtagtgcgtttttagtaaatctcaaatgaacttttgtggtcggatttgaacaaaaaaaaaaa

SEQ ID NO: 1380 - protein, 640 aa, Arabidopsis thaliana
  G1242,SWI/SNF domain coordinates 96-180,417-466,519-580
MSQMQKQYYKALLQKDLEVVNGGGERKRLLNIAMQLRKCCNHPYLFQGAEPGPPYTTGDHLVTNAGKMVLLDKLLPKLKDRDSRVLIFSQMTRLLDILEDYLMYRGYQYCRIDGNTGGDERDASIEAYNKPGSEKFVFLLSTRAGGLGINLATADVVILYDSDWNPQVDLQAQDRAHRIGQKKEVQVFRFCTENAIEAKVIERAYKKLALDALVIQQGRLAEQKTVNKDELLQMVRYGAEMVFSSKDSTITDEDIDRIIAKGEEATAELDAKMKKFTEDAIQFKMDDSADFYDFDDDNKDESKVDFKKIVSENWNDPPKRERKRNYSEVEYFKQTLRQGAPAKPKEPRIPRMPQLHDFQFFNIQRLTELYEKEVRYLMQAHQKTQMKDTIEVDEPEEVGDPLTAEEVEEKELLLEEGFSTWSRRDFNAFIRACEKYGRNDIKSIASEMEGKTEEEVERYAQVFQVRYKELNDYDRIIKNIERGEARISRKDEIMKAIGKKLDRYRNPWLELKIQYGQNKGKLYNEECDRFMICMVHKLGYGNWDELKAAFRTSPLFRFDWFVKSRTTQELARRCDTLIRLIEKENQEFDERERQARKEKKLSKSATPSKRPSGRQANESPSSLLKKRKQLSMDDYGKRRK

SEQ ID NO: 1381 - DNA, 1284 bp, Arabidopsis thaliana
  G1245,family:MYB-(R1)R2R3
atggggaaagttcgtcaagattcaggatcagacgatgacaattcaataaagaaatcttttactaaaggtccttggacacaagcagaagacaatcttttgatagcttacgttgataaacatggtgatggaaactggaacgctgttcaaaacaactcgggcctttctcgttgtggtaaaagttgtcgccttcgttgggtaaatcatctgagaccagatttgaaaaaaggcgcttttacagagaaagaagagaaacgtgtcatcgaacttcatgctttgttagggaacaaatgggcacgaatggctgaagaactaccgggacgaacagataatgagatcaagaacttctggaatacaagacttaagagactgcaacgacttggtttacctgtttaccccgatgaagttcgagagcatgcgatgaatgcagcgacacattccggtctaaacactgattcattggatggtcatcatagtcaagaatatatggaggcagatactgttgagattcctgaagtggatttcgagcatttaccactcaatcgatcttcttcatactaccagtcaatgcttcgacatgttcctcccactaacgtctttgtgagacaaaaaccgtgtttctttcagccgcctaatgtgtataacttgataccaccatctccttacatgtctaccggaaaacgtcctagagaaccagaaaccgcgtttccttgcccgggtggatataccatgaacgagcaaagccctcggctctggaactatccttttgttgagaacgtttcagaacagttaccggatagtcatttgcttggtaatgctgcttattcttctcctcctggacctcttgttcacggggttgagaatttcgagttcccttcattccaatatcatgaagagcctggcggttggggagcagatcaacctaacccaatgccggaacatgagtcagataacactttggttcaatctcctctgacagctcaaacaccatcagattgtccatcatcatcactctatgatggactgttggaatcagttgtctatggatcatcaggggagaaaccggcaaccgataccgattcagaatcttcactgtttcagtcatttacaccagccaatgaaaacataaccggtaaaacttgttttcttactctttatgcattacatgcacttcattgtttgtgtaatcaattcaagaagtctcctcttctccatctgcatgacaaacttaattggtgtaacaaatttaggttcaactccttcaaatcagggacacacatcctttga

SEQ ID NO: 1382 - protein, 427 aa, Arabidopsis thaliana
  G1245,MYB-(R1)R2R3 domain coordinates 22-122
MGKVRQDSGSDDDNSIKKSFTKGPWTQAEDNLLIAYVDKHGDGNWNAVQNNSGLSRCGKSCRLRWVNHLRPDLKKGAFTEKEEKRVIELHALLGNKWARMAEELPGRTDNEIKNFWNTRLKRLQRLGLPVYPDEVREHAMNAATHSGLNTDSLDGHHSQEYMEADTVEIPEVDFEHLPLNRSSSYYQSMLRHVPPTNVFVRQKPCFFQPPNVYNLIPPSPYMSTGKRPREPETAFPCPGGYTMNEQSPRLWNYPFVENVSEQLPDSHLLGNAAYSSPPGPLVHGVENFEFPSFQYHEEPGGWGADQPNPMPEHESDNTLVQSPLTAQTPSDCPSSSLYDGLLESVVYGSSGEKPATDTDSESSLFQSFTPANENITGKTCFLTLYALHALHCLCNQFKKSPLLHLHDKLNWCNKFRFNSFKSGTHIL

SEQ ID NO: 1383 - DNA, 911 bp, Arabidopsis thaliana
  G1277,family:AP2
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 1384 - protein, 153 aa, Arabidopsis thaliana
  G1277,AP2 domain coordinates 18-85
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 1385 - DNA, 1043 bp, Arabidopsis thaliana
  G129,family:MADS
cattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctctgtgatgctgaagtcgcactcatcgttttctctagccgtggtcgtctctatgagtactctaacaacagtgtaaaaggtactattgagaggtacaagaaggcaatatcggacaattctaacaccggatcggtggcagaaattaatgcacagtattatcaacaagaatcagccaaattgcgtcaacaaattatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgccggtcgccaagaccaaaccgctctccagttagtgtaatattggctgaaggaaatggcctggagtgaataaaaaccagaattgggttgagcaagcaatataaagctaatgcatgttatatatatatttatcccatgaatgttgtatcagtgaattcttatgcttatgttgatgtgaaattaaatatcttaaagacatgtcattaatgtgcttaatttgcttca

SEQ ID NO: 1386 - protein, 252 aa, Arabidopsis thaliana
  G129,MADS domain coordinates 18-73
TAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 1387 - DNA, 994 bp, Arabidopsis thaliana
  misc_feature (13)..(13): n is a, c, g, or t
  misc_feature (15)..(15): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (38)..(40): n is a, c, g, or t
  misc_feature (42)..(42): n is a, c, g, or t
  misc_feature (44)..(44): n is a, c, g, or t
  misc_feature (60)..(60): n is a, c, g, or t
  misc_feature (70)..(70): n is a, c, g, or t
  misc_feature (72)..(72): n is a, c, g, or t
  misc_feature (78)..(78): n is a, c, g, or t
  misc_feature (93)..(93): n is a, c, g, or t
  misc_feature (96)..(96): n is a, c, g, or t
  misc_feature (101)..(101): n is a, c, g, or t
  misc_feature (103)..(104): n is a, c, g, or t
  misc_feature (108)..(108): n is a, c, g, or t
  misc_feature (110)..(110): n is a, c, g, or t
  misc_feature (117)..(117): n is a, c, g, or t
  G1307,family:MYB-(R1)R2R3
cccttattgggcntnancgnccncccggcaggtctagnnntnancgcccgcgtccttctnccattttacncncttgcngcccacccttgtatntcnttttntnngtgntntttttcntgagggggcaacggaaaaaagaatgggaagagcaccatgttgtgagaaaatgggggtgaagagaggaccatggactcctgaagaagatcaaatcttgatcaattatattcatctttatggtcattctaattggcgagctctcccaaaacacgcaggtttacttagatgtgggaaaagttgcagacttggttggatcaattatcttagaccagacattaaacgtggcaatttcactcctcaagaagaacaaactattatcaatctgcatgaaagcttaggcaacagatggtctgcgattgctgcaaaattgccgggacgaaccgacaatgaaataaaaaatgtttggcacactcatttgaagaaaagactcagcaaaaatctaaacaatggcggagacaccaaagacgttaacggaattaacgagaccacaaatgaagacaaaggatctgtgatagtcgacacagcctctttacaacaattttctaatagtattacaacatttgatatttcaaatgataacaaggacgatattatgtcgtacgaggatatttctgccttgatagatgatagtttttggtcggacgtcatatcggtagataattcgaataagaatgagaagaagatagaggattgggaaggattgatcgatagaaatagtaaaaaatgtagctatagtaattctaagttgtataatgatgacatggagttttggtttgatgttttcactagtaatcgtagaattgaggaattttccgacatacccgagttttaattttgattttgattttgtgttgtttttgtcgttaagactttgaaagtctttttgtaatccaaatgaataaattccttttctttttaaaaaaaaaaaaaaaaaaaa

SEQ ID NO: 1388 - protein, 249 aa, Arabidopsis thaliana
  G1307,MYB-(R1)R2R3 domain coordinates 14-114
MGRAPCCEKMGVKRGPWTPEEDQILINYIHLYGHSNWRALPKHAGLLRCGKSCRLGWINYLRPDIKRGNFTPQEEQTIINLHESLGNRWSAIAAKLPGRTDNEIKNVWHTHLKKRLSKNLNNGGDTKDVNGINETTNEDKGSVIVDTASLQQFSNSITTFDISNDNKDDIMSYEDISALIDDSFWSDVISVDNSNKNEKKIEDWEGLIDRNSKKCSYSNSKLYNDDMEFWFDVFTSNRRIEEFSDIPEF

SEQ ID NO: 1389 - DNA, 1041 bp, Arabidopsis thaliana
  G1321,family:MYB-(R1)R2R3
gttcttgtattggtttggatcggtatacttagttgattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttccccggaaagatcgctttaagtcacaaagcaaatcagagtaagaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaaaaaaaaaaaa

SEQ ID NO: 1390 - protein, 243 aa, Arabidopsis thaliana
  G1321,MYB-(R1)R2R3 domain coordinates 4-106
MIMCSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARRTRQTSKPRLLPSTTSSSSLMASEQIMMSSGGYNHNYSSDDRKKIFPADFINFPYKFSHINHLHFLKEFFPGKIALSHKANQSKKPMEFYNFLQVNTDSNKSEIIDQDSGQSKRSDSDTKHESHVPFFDFLSVGNSAS

SEQ ID NO: 1391 - DNA, 1088 bp, Arabidopsis thaliana
  G1323,family:MYB-(R1)R2R3
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 1392 - protein, 273 aa, Arabidopsis thaliana
  G1323,MYB-(R1)R2R3 domain coordinates 15-116
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 1393 - DNA, 1662 bp, Arabidopsis thaliana
  G1325,family:MYB-(R1)R2R3
atgagttacacgacggcgactgctgatagtgatgatggtatgcactccagcatccataatgaatcaccagctcctgatagtattagcaatggctgcagaagtagagggaaaagaagtgtcctgaagaaaggaccatggacttcaactgaagacgggattttaattgattatgtaaagaagcacggcgagggtaactggaatgctgtgcagaaacacactagcctggcccgttgtggtaaaagctgtcgtctgagatgggctaatcatctgaggccaaacttgaagaaaggagcatttagccaagaagaagaacagctcattgttgaaatgcacgccaagatgggaaataaatgggcacagatggctgaacatttacctggtcgaacagataatgagataaagaattattggaacactcgtatcaagaggagacaacgagcaggcttaccactttaccctcctgaaatctatgttgatgaccttcattggagcgaagagtatacaaagagtaatatcataagagtagatagaagaagaagacatcaagatttcttgcagttggggaattctaaagataatgtcttatttgacgatctaaattttgctgctagcttgttacctgccgcttctgacctatcagatttggttgcatgcaacatgctaggaactggcgcaagttcttcccggtatgagagctacatgccaccaatattgccttccccaaagcaaatctgggaatctggatctcggtttcccatgtgcagcagtaacataaagcatgaattccaatcgccggaacactttcagaatacggctgtacagaagaatcccagatcttgcagtatctcgccttgtgatgttgatcatcatccttatgaaaaccaacattcgtctcatatgatgatggttcctgatagccatacagttacgtatggcatgcatcctacttctaagcccttgtttggggcagtgaagctggagctcccttcattccaatattcagaaactagtgcatttgatcagtggaagacgactccgtcacctccacactcagatctccttgactctgttgatgcctatattcaatctccaccaccatcgcaggtagaggagtcagattgtttctcttcatgcgacaccggcctactagatatgttacttcatgaggccaagatcaaaactagtgcgaagcacagtttgttgatgtcatcaccccagaagagtttcagttcaactacttgcacgaccaatgttactcagaatgtaccacgtggcagcgaaaacctgatcaaatcaggagaatatgaagattcccaaaagtatttgggtcgctccgagattacaagtccctcgcaacttagtgcaggtggtttttcatcagcttttgcagggaatgttgtaaagacagaagagttggatcaggtttgggaaccaaagagagttgatataacacggcctgatgttttacttgcgtcgagctggcttgaccaaggctgttatggcattgttagtgacacaagcagcatgagtgatgcgcttgcacttcttggtggtgacgacattgggaacagttacgtgactgttgggtcatcatcaggtcaagcaccacgaggcgtcgggtcttatggatggaccaatatgcctcctgtttggtcgctgtaa

SEQ ID NO: 1394 - protein, 553 aa, Arabidopsis thaliana
  G1325,MYB-(R1)R2R3 domain coordinates 43-147
MSYTTATADSDDGMHSSIHNESPAPDSISNGCRSRGKRSVLKKGPWTSTEDGILIDYVKKHGEGNWNAVQKHTSLARCGKSCRLRWANHLRPNLKKGAFSQEEEQLIVEMHAKMGNKWAQMAEHLPGRTDNEIKNYWNTRIKRRQRAGLPLYPPEIYVDDLHWSEEYTKSNIIRVDRRRRHQDFLQLGNSKDNVLFDDLNFAASLLPAASDLSDLVACNMLGTGASSSRYESYMPPILPSPKQIWESGSRFPMCSSNIKHEFQSPEHFQNTAVQKNPRSCSISPCDVDHHPYENQHSSHMMMVPDSHTVTYGMHPTSKPLFGAVKLELPSFQYSETSAFDQWKTTPSPPHSDLLDSVDAYIQSPPPSQVEESDCFSSCDTGLLDMLLHEAKIKTSAKHSLLMSSPQKSFSSTTCTTNVTQNVPRGSENLIKSGEYEDSQKYLGRSEITSPSQLSAGGFSSAFAGNVVKTEELDQVWEPKRVDITRPDVLLASSWLDQGCYGIVSDTSSMSDALALLGGDDIGNSYVTVGSSSGQAPRGVGSYGWTNMPPVWSL

SEQ ID NO: 1395 - DNA, 925 bp, Arabidopsis thaliana
  G1329,family:MYB-(R1)R2R3
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 1396 - protein, 212 aa, Arabidopsis thaliana
  G1329,MYB-(R1)R2R3 domain coordinates 7-111
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 1397 - DNA, 1274 bp, Arabidopsis thaliana
  G1334,family:CAAT
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 1398 - protein, 269 aa, Arabidopsis thaliana
  G1334,CAAT domain coordinates 133-190
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 1399 - DNA, 1630 bp, Arabidopsis thaliana
  G1337,family:Z-CO-like
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 1400 - protein, 433 aa, Arabidopsis thaliana
  G1337,Z-CO-like domain coordinates 9-75
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 1401 - DNA, 895 bp, Arabidopsis thaliana
  G136,family:MADS
ggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttctttgcttc

SEQ ID NO: 1402 - protein, 248 aa, Arabidopsis thaliana
  G136,MADS domain coordinates 18-74
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 1403 - DNA, 1017 bp, Arabidopsis thaliana
  G1381,family:AP2
cagctttaacactactctctctctctctcaaatgggaaaacaaatcaacatagagagtagtgctactcatcatcaagacaatattgtttccgttataacagccacgatatcctcctcctccgtcgtaacgtcttcgtcagactcttggtctacctccaaaagatcgttagtgcaagacaatgactccggagggaaacggcggaagagcaacgttagtgatgataacaagaatccgacgtcgtatagaggagtgaggatgaggagttggggaaaatgggtgtcggagattagagagccgaggaagaaatcaagaatatggcttggcacttatccaacggcagagatggcagctcgtgctcatgatgtggcggctttagctattaaaggcaactccggttttcttaatttccctgaattatccggtttgcttcctcgtccggttagctgctctcctaaggatatacaagctgcagctaccaaagccgccgaagcaaccacgtggcacaaaccggttatcgataagaaattagctgatgagctaagccactctgagttgttgtctaccgctcagtcttcgacttctagtagtttcgtgttttcttcggacacgtcggagacttctagtacggacaaggaaagcaacgaagagacggtgtttgatttgccggaccttttcacggacgggcttatgaacccaaacgatgcgttttgtttatgcaacggcacctttacgtggcagctttacggagaggaggatgtagggttcaggtttgaagagccgtttaattggcaaaatgactaaaccgccctccacttgcttactgtaattactaacatataattttcttgataaagaacatatatttccattacggtattaactaatcttttctatccttttctcttttcttgtttctacatctgagtatattgtcactatgtgaaaaaattgatctcgttttgaatatttacttttcaaaattgaagtaacgcaagtgattgataaaaaaaaaaaaa

SEQ ID NO: 1404 - protein, 256 aa, Arabidopsis thaliana
  G1381,AP2 domain coordinates 68-135
MGKQINIESSATHHQDNIVSVITATISSSSVVTSSSDSWSTSKRSLVQDNDSGGKRRKSNVSDDNKNPTSYRGVRMRSWGKWVSEIREPRKKSRIWLGTYPTAEMAARAHDVAALAIKGNSGFLNFPELSGLLPRPVSCSPKDIQAAATKAAEATTWHKPVIDKKLADELSHSELLSTAQSSTSSSFVFSSDTSETSSTDKESNEETVFDLPDLFTDGLMNPNDAFCLCNGTFTWQLYGEEDVGFRFEEPFNWQND

SEQ ID NO: 1405 - DNA, 844 bp, Arabidopsis thaliana
  G1387,family:AP2
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 1406 - protein, 189 aa, Arabidopsis thaliana
  G1387,AP2 domain coordinates 4-71
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 1407 - DNA, 1000 bp, Arabidopsis thaliana
  G1390,family:IAA
gtttctttaaggtcttagggtttagtgaagctatagatttcaatttcatacatagttaacgtatagaaggaatcttgggttgatcaatggaaggttgtccaagaaacagagaaatcggtccaaaacttcttgatttgattccacaaggaaggaaatggtaccaagaagacaagaacaacacagatcaggagaagaaacttgagctaaggctgcaccgtggtgatgaagaagatcattcagcaatcaagaagaagaacacagagataagaaacatcaagaaggaaacagaagacaaatctttccactgttttaatggcaatcacttctctccttccaacaaaaccacttctgttcctcacatctcacagaaaagaactgctcctggtccagtggtgggttggcctccggttcgttcgttcagaaagaatctagcgagcacaagctcttcaaagctaggtaacgaatcctctcatggaggtcaaatcaacaagagtgatgatggtgaaaaacaagttgaaaccaagaaggaaggaatgtttgtcaagatcaacatggatggtgttcctattggtcgtaaagttgatctcaatgcttacaacagctacgaacagctctcttttgtcgttgacaaactcttcagaggtctactcgcagctcaaagagatatctctgatggtcaaggagaagagaaacctatcattggattattagatgggaaaggagaatttactttaacctatgaagacaatgaaggggacaagatgcttgttggggatgttccatggcaaatgtttgtttcatctgtgaagagactgcgtgtgattaaaagctctgagatttcatctgccttgacatttggatgcagtaagcaagagaagatgatgcactgaagagtctttttagaaacttttatttcagacagagagtctcaaagctttataaatgtacatctggtttttgttatatataagagttaatcattggtttaaaaaaaaaaaaa

SEQ ID NO: 1408 - protein, 267 aa, Arabidopsis thaliana
  G1390,IAA domain coordinates NA
MEGCPRNREIGPKLLDLIPQGRKWYQEDKNNTDQEKKLELRLHRGDEEDHSAIKKKNTEIRNIKKETEDKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 1409 - DNA, 436 bp, Arabidopsis thaliana
  G1396,family:S1FA
tcgacctcgtttcctttcctcctctcttcctaccattagtacgttactggagctgatctcacgtatattttggatcgtaatcatggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataaaagccagcttaagcttccttcacttgtgcctccttcaaagcggtttttgttcggttaccaaatttcacccttgcgggtttttttcttcctttacttctgtcatgaggattatctttgaggcct

SEQ ID NO: 1410 - protein, 76 aa, Arabidopsis thaliana
  G1396,S1FA domain coordinates 1-76
MDGEDFAGKAAAEAKGLNPGLIVLLVVGGPLLVFLIANYVLYVYAQKNLPPRKKKPVSKKKLKREKLKQGVPVPGE

SEQ ID NO: 1411 - DNA, 1498 bp, Arabidopsis thaliana
  G14,family:AP2
gaagaagcaaagatataacccccaaaagtatcaattagtttccattttcgccgctaagattctgttttcgaacatttacaccctcaagaatcgccgccatgtgtggaggagctataatatccgatttcattccaccgccgaggtctcgccgtgttactagcgagtttatttggccggatctgaagaagaatttgaaaggatcgaagaaaagctcgaagaatcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggttcagtttttggtaagaaagttactggcttggatggggacgctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacatgaaggctaattctcagaaacgctctgtgaaggctaatcttcagaaaccagtggctaaacctaaccctaacccaagtccagctttggttcagaactcgaacatctcctttgaaaatatgtgtttcatggaggagaaacaccaagtgagcaacaacaacaacaaccagtttgggatgacaaactccgttgatgctggatgtaatgggtatcagtatttcagctctgaccagggtagtaattctttcgattgttcggagtttggttggagcgatcaagctccgataactcccgacatctcttctgcggttatcaacaacaacaactcagctctgttctttgaggaagccaatccagctaagaagctcaagtctatggatttcgagacaccttacaacaacactgaatgggacgcttcactggatttcctcaacgaagatgctgtaacgactcaggacaatggtgcaaaccctatggacctatggagtattgatgaaattcattccatgattggaggagtcttctgaagagatccagtttcatgtaaataaggctgcatgtttgtgagtttcccgcatcgttcgtttatcaacctccaaaactttctaatgtctgttacttgcatcttcttctgctgtctctgtctgtctctctcaggagttcctgtttgcattgcgagaagccatgagcctctatcttgagggtagttgtgatgaagttaagtagaggcttatttttaggggttgtggtagtttttgttttagtgaatcttttgaattcgtttgtgttttgtttttgttactttatgccccaaaactcctttaacatttgtcataatgtgtttgaacct

SEQ ID NO: 1412 - protein, 358 aa, Arabidopsis thaliana
  G14,AP2 domain coordinates 122-184
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGDAEKSANRKRKNQYRGIRQRPWGKWAAEIRDPREGARIWLGTFKTAEEAARAYDAAARRIRGSKAKVNFPEENMKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 1413 - DNA, 1258 bp, Arabidopsis thaliana
  G1416,family:AP2
attttttttcctctttactttacacaaaggaacaacaaataatgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttgggactgtgggaagcaagtgtacttaggtggatttgacactgcacatgctgctgctcgagcctatgatcgagcggcgattaaattcagaggtgtagatgcagatattaatttcgacattgaagactaccttgacgatttgaaacagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtacgtttatttgggtctctttgataccgagattgaagctgctagagcttatgataaagcggcaataaagtgtaatgggaaagacgctgttaccaattttgaccctaaagtatacgaggaagaagaagatcttagctcagagacgacgaggaacggtcataatcttggtctaagtctaggagaatcatcatctgaagagtttagactcaagtctgatattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctgattcatcatcatcatcatcactatcatcacaatcatcatctgagctagtgttaaccaagttatgctttaatgaatttgagttattctcgagctatttttgggctctgtaatacatatatgttcttgagtacggtataacaagtttttttcttttggtaa

SEQ ID NO: 1414 - protein, 352 aa, Arabidopsis thaliana
  G1416,AP2 domain coordinates 94-160,186-253
MWNLNDSPDHHEESDSRGNPVGHVSNGMSQSATWLPFVLPVTRNFFPAQSMEPGVRWSGFNSVGKSDPSGSGRPEEPEISPPIKKSRRGPRSRSSQYRGVTFYRRTGRWESHIWDCGKQVYLGGFDTAHAAARAYDRAAIKFRGVDADINFDIEDYLDDLKQMGNLTKEEFMHVLRRQSTGFPRGSSKYRGVTLHKCGRWESRLGQFLNKKYVYLGLFDTEIEAARAYDKAAIKCNGKDAVTNFDPKVYEEEEDLSSETTRNGHNLGLSLGESSSEEFRLKSDIASIRSRIRDEERLLGSDLSLAMMTTTVRSEKQQSDGGGNRVVGMAASSGFSPQPSPYRIPRTFHFSRP

SEQ ID NO: 1415 - DNA, 1093 bp, Arabidopsis thaliana
  G142,family:MADS
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttgactctctgttgattagcccacgatgccacggtcaggccaatttcagctctctacagttgttcttttttcaaattagatttctggttttttttttcctataagaaaaacttttgcactagatgtttgtcatttaatttccagctcgtgtgaatctatattcgcatgtatgtgctttgaagaatttctcctcttactcctacttgatctaaaacattatttttcttttgggttt

SEQ ID NO: 1416 - protein, 252 aa, Arabidopsis thaliana
  G142,MADS domain coordinates 2-57
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 1417 - DNA, 861 bp, Arabidopsis thaliana
  G1424,family:MADS
cgagattgagagattatggctttcacttgtcaattatctttctccacgcaaaaacaaaaaccgtcgctgtggtgaaatagataaaatcagaatggtgaaaaaaggaggtacgaagaggaagattgcgattgagacgatacagaagagcgattaccttagggttacttgcaccaaacgtcgtgaaggtctctttagcaaagcttctcagctttgtcttctctccgatgcacagatcgctatcttagcgactcctcctacttctgaatccaacatctccttctactctttcggtcactcctccgttgatgccgttgtctcttctttcctctccgggcaacgttgtgttcctcttcaggaggataccaaagagatgagagaggacgttgctatttgcttgtctcgtacaaatctagggttagggttttggtggaacaacgagagcctcaacaaatcggagaatcctcaagagattagtgacgctatcaactctatgttaacgctcttgagtaatctcaaggaattgagtggggaggaagctttagttaacgatcacaaggacttgaagaagaatgagaggagcgatgttgttttacaacacggaactcaatatgaaaccctaaatcctaactccaacactactacaatttgttgcgtccctgatgaattacctgccaattccaacgagattgttggaatctcaccaaatcctttgattatgctagaaaagaagaaatcacaaattgaagaaaagtttgagaaggaatggcaagtttcagttactcgaattgaaaatgaagccacgagttcttatgcaaaacgaagaagaagtatatgacctggattaattgaattaggaaaaag

SEQ ID NO: 1418 - protein, 247 aa, Arabidopsis thaliana
  G1424,MADS domain coordinates NA
MVKKGGTKRKIAIETIQKSDYLRVTCTKRREGLFSKASQLCLLSDAQIAILATPPTSESNISFYSFGHSSVDAVVSSFLSGQRCVPLQEDTKEMREDVAICLSRTNLGLGFWWNNESLNKSENPQEISDAINSMLTLLSNLKELSGEEALVNDHKDLKKNERSDVVLQHGTQYETLNPNSNTTTICCVPDELPANSNEIVGISPNPLIMLEKKKSQIEEKFEKEWQVSVTRIENEATSSYAKRRRSI

SEQ ID NO: 1419 - DNA, 1410 bp, Arabidopsis thaliana
  G1426,family:NAC
atgaatcagaatcttcatgtattatcaatggattcgttaccagttggattaagattccgtccaacagacgaggagctaatccgttactatctccgtaggaaaatcaacggtcacgatgacgacgtcaaagctatccgtgagatcgatatttgcaaatgggaaccttgggatttacctgatttttctgtgatcaaaactaaagactcagagtggctctacttctgtccattggatcggaagtatccgagtggaagtagacagaaccgggcaacagttgcagggtactggaaagccacaggaaaagaccggaagataaaatccggtaagactaacattattggtgtgaagagaactctagttttccacgcgggtagagctcctagggggacacgaaccaattggattattcatgagtatcgtgccacggaggatgatcttagtggtaccaatcctggccagagtccgtttgttatatgcaaattgttcaagaaagaagaactggttttaggggaagaagattcgaagtcagatgaagttgaagaacctgctgtctcgtctccaactgtcgaagtgactaagtcagaagtatctgaggtaattaaaacagaagacgtgaagcgtcatgacatagcagaatcttctcttgtaatctctggagattctcatagtgatgcttgtgatgaggctacaaccgcagagcttgtagattttaaatggtatccggaattggagtccttagatttcacgctgttctctccattacactctcaagtccaatctgagcttggatcctcttacaacacattccagcctggctcgagtaatttttcagggaacaacaacaacagcttccaaatccagactcagtatggtacaaatgaagtagatacgtatatatctgattttcttgattcgattctcaagagcccagacgaggatccagagaagcacaagtatgttttgcaaagtggttttgatgttgtagcaccagatcagattgcgcaagtgtgtcaacagggctcagcagttgacatgagcaatgatgtttcagtgacgggtatccagattaagagtcgccaggcacaaccctcaggttataccaatgactatatagcgcagggaaatggtccaagaaggctgcgtctgcaaagtaactttaatggcattaacacgaagaatcctgagcttcaagctataaagagagaggctgaggacacggttggagaaagtataaagaaaaggtgtggaaagctaatgagatcaaagaacgtgaccggttttgtgtttaaaaagattacgtcggtgaaatgttcatatggaggactctttagggcggcagtagttgcagttgtgttcttgatgtcagtctgcagtctaaccgtcgacttcagagcatctgcagtgtcctga

SEQ ID NO: 1420 - protein, 469 aa, Arabidopsis thaliana
  G1426,NAC domain coordinates 3-131
MNQNLHVLSMDSLPVGLRFRPTDEELIRYYLRRKINGHDDDVKAIREIDICKWEPWDLPDFSVIKTKDSEWLYFCPLDRKYPSGSRQNRATVAGYWKATGKDRKIKSGKTNIIGVKRTLVFHAGRAPRGTRTNWIIHEYRATEDDLSGTNPGQSPFVICKLFKKEELVLGEEDSKSDEVEEPAVSSPTVEVTKSEVSEVIKTEDVKRHDIAESSLVISGDSHSDACDEATTAELVDFKWYPELESLDFTLFSPLHSQVQSELGSSYNTFQPGSSNFSGNNNNSFQIQTQYGTNEVDTYISDFLDSILKSPDEDPEKHKYVLQSGFDVVAPDQIAQVCQQGSAVDMSNDVSVTGIQIKSRQAQPSGYTNDYIAQGNGPRRLRLQSNFNGINTKNPELQAIKREAEDTVGESIKKRCGKLMRSKNVTGFVFKKITSVKCSYGGLFRAAVVAVVFLMSVCSLTVDFRASAVS

SEQ ID NO: 1421 - DNA, 983 bp, Arabidopsis thaliana
  G1453,family:NAC
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgct

SEQ ID NO: 1422 - protein, 292 aa, Arabidopsis thaliana
  G1453,NAC domain coordinates 13-160
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 1423 - DNA, 1989 bp, Arabidopsis thaliana
  G1455,family:NAC
cgtcgacatgaaccaaataaaaaacaaaactttaccggagatgacgacggagcaagctttgttgtctatggaagctttacctttaggtttcagattcagaccaacggatgaagaactcatcaatcattacctaaggttaaaaatcaacggccgtgatttagaggttagagtcatccctgagatcgatgtttgcaagtgggaaccatgggacttacctgggctatcggtgataaagacagatgatcaagaatggttctttttttgtcctcgtgatcgaaagtatccgagtggtcatcgttctaatagagctactgatattggttactggaaagctactgggaaagatcgaactattaagtctaagaagatgattattggtatgaagaagactcttgttttctatcgtggaagagctcctagaggagagcgtactaattggattatgcatgagtatcgtgctacagacaaggaactagatggtactggacctggtcagaatccgtatgttttgtgtcgcttgttccacaagcctagtgatagttgtgatcctgcacactgtgaggaaatagagaaagttaattttactccaaccaccaccactagatgctctcctgatgacacatcttctgaaatggtccaagaaacagctacatctggtgtacatgctctagatagatcagatgacactgagaggtgtttaagtgacaagggcaataatgatgtgaaacctgatgtttcagtgataaacaatacttctgtcaatcacgctgaaacttctcgtgccaaagaccgtaatttgggcaagacgttagtagaggaaaatccacttctaagggacgttccaactcttcatggacccatcttgagtgagaaatcatattatccaggacagtcaagcatcggttttgctacatctcacatggattctatgtattctagtgattttggaaactgtgattatgggctacattttcaagatggtgcctctgaacaagatgcatctttaacagatgtcttggatgaagtattccataaccataatgaatcctctaatgacaggaaagactttgtacttccgaatatgatgcattggcctggtaatacaagactgttgtctactgagtacccatttctcaaagattctgttgcttttgttgacggcagtgctgaagtttccggctcacagcaatttgttcctgacattttagcttctagatgggtcagtgaacagaacgttgatagcaaggaggcagtagagattctatcttcaaccgggtcctctcggaccttgacgccacttcataacaacgtttttgggcaatatgcttcatcgtcttacgcagctatcgatccatttaactataatgtcaatcagcctgaacagtcatcctttgagcaaagccatgttgaccgcaacattagtcccagtaacatttttgagttcaaggctaggtctcgagagaatcagagagatctggactctgttgtggaccaaggcactgctcctagaagaattcggctgcagatcgaacagccattgacgccagttaccaacaagaaagagagagatgcggacaactatgaagaagaagatgaagtacaatctgccatgtccaaggtcgtagaggaagaaccggctaatttaagtgctcaggggactgctcagaggagaatccgcctgcagacgagattgaggaagcctctcataaccctaaacaatacaaaaagaaactcaaatggcagagaaggagaagcaagccataggaagtgtgaaatgcaggaaaaagaagatatatcatcatcatcatcatggcagaaacagaagaagagcttggtgcagtttagtagtgtggtgataatagtggcggtgatagttgttttagtagaaatatggaaagagtcaagagatgcgaaatgtagcttcttgtttcatcaattagattccttcaaaggcatgtttacttgatgatatattgtgccgcggccgct

SEQ ID NO: 1424 - protein, 652 aa, Arabidopsis thaliana
  G1455,NAC domain coordinates 24-178
MNQIKNKTLPEMTTEQALLSMEALPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDSCDPAHCEEIEKVNFTPTTTTRCSPDDTSSEMVQETATSGVHALDRSDDTERCLSDKGNNDVKPDVSVINNTSVNHAETSRAKDRNLGKTLVEENPLLRDVPTLHGPILSEKSYYPGQSSIGFATSHMDSMYSSDFGNCDYGLHFQDGASEQDASLTDVLDEVFHNHNESSNDRKDFVLPNMMHWPGNTRLLSTEYPFLKDSVAFVDGSAEVSGSQQFVPDILASRWVSEQNVDSKEAVEILSSTGSSRTLTPLHNNVFGQYASSSYAAIDPFNYNVNQPEQSSFEQSHVDRNISPSNIFEFKARSRENQRDLDSVVDQGTAPRRIRLQIEQPLTPVTNKKERDADNYEEEDEVQSAMSKVVEEEPANLSAQGTAQRRIRLQTRLRKPLITLNNTKRNSNGREGEASHRKCEMQEKEDISSSSSWQKQKKSLVQFSSVVIIVAVIVVLVEIWKESRDAKCSFLFHQLDSFKGMFT

SEQ ID NO: 1425 - DNA, 1374 bp, Arabidopsis thaliana
  G1458,family:NAC
atggtgaaagatctggttgggtatagattttatccaacgggagaggaattgataaaccattatctaaagaacaaaattttgggtaagacttggctcgtcgacgaagccattagcgagatcaacatctgtagttacgacccaatttacttgccttctttatcgaagataaaatcggatgatcctgtgtggtacttcttctgtccaaaggagtatacttctgcgaagaagaaggtaacgaagaggactacaagttcagggtattggaaagctactggtgttgataggaaaatcaaagataagagaggtaatcgcggcgagattgggataaagaagacgcttgtgtattatgaaggtagagttcctaaaggtgtttggactccttgggttatgcatgagtatcacatcacttgtttgcctcaagatcagaggaactatgttatctgccaagtgatgtataagggtgaagatggagacgtcccatctggtggtaacaactcgagtgagccgagtcaatctttggtctctgattcgaatactgtcagagctacgagtcccacagcgcttgagtttgagaagccaggtcaagaaaatttctttggtatgtctgtggatgatttggggactccaaagaatgaacaagaagatttctctttgtgggatgtactggatccagacatgttattcagtgacaataacaatcctactgtgcatccacaagctcctcacttaaccccgaatgatgatgagtttctcggtggattgaggcatgttaaccgagagcaggttgaatatttgtttgccaatgaagatttcatatccagaccaaccttatctatgaccgagaaccgcaacgatcacaggccaaagaaggctttgtcagggattattgttgattatagcagtgatagtaatagtgatgctgaatcgatatctgcaacgagttaccaaggaacatcaagtccaggtgatgatagtgttggtagttcgaatagacaatttctccagactggtggagatgagattctatcgtcttgcaatgatctacaaacctatggagaaccttccatcagtagtagcacccggcaatctcaactcacacgaagcatcatacgaccaaaacaagaggtgaaacaagatacatcaagagcggttgatagtgatacatccatagacaaggagtcatctatggtgaagacagagaagaagagctggtttattacagaggaagcaatggagagaaaccgcaacaatccacggtatatctatctcatgagaatgatcataggcttcattctcttgctggctctcattagcaacatcatatcggtgttacaaaacttgaacccggcgatgaagtttgatcgcgagagatag

SEQ ID NO: 1426 - protein, 457 aa, Arabidopsis thaliana
  G1458,NAC domain coordinates 11-153
MVKDLVGYRFYPTGEELINHYLKNKILGKTWLVDEAISEINICSYDPIYLPSLSKIKSDDPVWYFFCPKEYTSAKKKVTKRTTSSGYWKATGVDRKIKDKRGNRGEIGIKKTLVYYEGRVPKGVWTPWVMHEYHITCLPQDQRNYVICQVMYKGEDGDVPSGGNNSSEPSQSLVSDSNTVRATSPTALEFEKPGQENFFGMSVDDLGTPKNEQEDFSLWDVLDPDMLFSDNNNPTVHPQAPHLTPNDDEFLGGLRHVNREQVEYLFANEDFISRPTLSMTENRNDHRPKKALSGIIVDYSSDSNSDAESISATSYQGTSSPGDDSVGSSNRQFLQTGGDEILSSCNDLQTYGEPSISSSTRQSQLTRSIIRPKQEVKQDTSRAVDSDTSIDKESSMVKTEKKSWFITEEAMERNRNNPRYIYLMRMIIGFILLLALISNIISVLQNLNPAMKFDRER

SEQ ID NO: 1427 - DNA, 1272 bp, Arabidopsis thaliana
  G1459,family:NAC
atgatgaaaggtctgattgggtatagatttagtccgacgggagaggaagtgatcaaccattacctaaagaacaaacttctgggtaagtattggctcgttgatgaagctattagcgagatcaacatcttgagtcacaaacccagcaaggatttgcctaagttagctaggatccaatcggaagatcttgaatggtatttcttctctccgattgagtacacgaacccgaataagatgaaaatgaagaggacgacaggttctgggttttggaaacctactggtgttgatcgggaaattagggataaaagaggaaatggtgttgtgatagggattaagaagacgcttgtgtaccatgaaggtaagagtcctcatggagttagaactccttgggttatgcacgagtatcacatcacttgcttgcctcatcataagaggaaatatgttgtctgccaagtaaagtataagggtgaagctgcagaaatttcatatgagccaagtccctctttggtatccgattcgcataccgtcatagcgattaccggagaaccggaacctgagcttcaggttgagcagccaggtaaagaaaatctcttgggtatgtctgtagatgatttgatagaaccaatgaaccaacaagaggagccacaaggtcctcacttagctccgaatgatgatgagtttatacgtggattgaggcatgttgatcgagggacggttgaatatttgtttgccaatgaagaaaacatggatggtttgtctatgaatgacttgagaatcccaatgatcgtccaacaagaggatctctctgagtgggagggatttaacgcagacacctttttcagcgacaacaacaataactataaccttaacgtgcatcatcaactaacgccttacggcgatggctatttgaatgcattttcgggttataacgaagggaatcctcccgatcacgaattagtgatgcaagagaaccgcaacgatcacatgccaaggaaacctgtgacagggaccattgattatagcagcgatagtggcagtgatgctggatccatatctacaacggtgaaacaagaaatcccaagagctgttgatgcacccatgaacaatgagtcatctttggtgaaaacagagaagaaaggcttgtttattgtagaggacgcaatggagagaaaccgcaagaaaccacgatttatctatctcatgaagatgatcataggcaacatcatatcggttttactacccgtcaaaagattgatcccggtgaagaagttatga

SEQ ID NO: 1428 - protein, 423 aa, Arabidopsis thaliana
  G1459,NAC domain coordinates 10-152
MMKGLIGYRFSPTGEEVINHYLKNKLLGKYWLVDEAISEINILSHKPSKDLPKLARIQSEDLEWYFFSPIEYTNPNKMKMKRTTGSGFWKPTGVDREIRDKRGNGVVIGIKKTLVYHEGKSPHGVRTPWVMHEYHITCLPHHKRKYVVCQVKYKGEAAEISYEPSPSLVSDSHTVIAITGEPEPELQVEQPGKENLLGMSVDDLIEPMNQQEEPQGPHLAPNDDEFIRGLRHVDRGTVEYLFANEENMDGLSMNDLRIPMIVQQEDLSEWEGFNADTFFSDNNNNYNLNVHHQLTPYGDGYLNAFSGYNEGNPPDHELVMQENRNDHMPRKPVTGTIDYSSDSGSDAGSISTTVKQEIPRAVDAPMNNESSLVKTEKKGLFIVEDAMERNRKKPRFIYLMKMIIGNIISVLLPVKRLIPVKKL

SEQ ID NO: 1429 - DNA, 1392 bp, Arabidopsis thaliana
  G1461,family:NAC
accgcccgcccgggcaggttaaacagtgaaaaaatatccgtggaagaagggtagttgagaaataaaaagagatcaacaagggtaaattaatcaatacgaaacttagatataacggttgccattaacttaaaagcacatttatgaacatgagtcttcttcgcttcatctccaagaaacaacactcatttttgcgtttaatctttctctctctcttgatcgatttagtttctttatgaggacgaaccaatgaaagttgaagacgaagcaacttatgagcttatcaaagacgaactgatgaaagcagaagacgaagcaacttattggctaatcaaagaagaactgatcaaagcagaagacgatgtaatcatctcacgttatctgaagcgtatgatcgttaacggggattcgtggcctgatcacttcatcgaagatgtagacgtgttcaacaagaatccaaatgaggagtttcattctcagagccctagattcgtgatcgttaaaccacgaacagagaattgtggtagaaccgatggatgtcaatctggttgctggaggatcattggtcgtgataaactgataaaatcgaaggagactgggaagattctagggttcaagaagattctcaagttctgcctaaagaagaaacctagagaatacaagagaagttgggtaatggaagagtacaggcttaacaataacttgaactgcaagcaagatcatgtgatttgcaagattcggtttatgttcgatgctgaaatcagtttcttgctagccaagcatttctcgtgtctctccactagatcaccgcttcctgcaaatcaattgttgccagcttatggagtctgtttcttcgattcagaagcggagggtgcattttatctggagacgataatcggttatgatggaaacacttggcctagctacgttaccaacgatgtgtaccgtttgcatccgttgacgcttgtggatcctcaagatgacaagtttaaagagttcggaacctgtatctttgctaacaggacaaagacttgtggtaaaaccgatgaatgtgatggtggtggttgctggaggatcgtagaaggtcatagagttatcaagtcaaaaggtaaggttcttggttacaggaggatttttcaattttcggaaaatgaggaaccaagaaatgtttgtgaaggagaagatccgaagaaaactgcttggttcatagaagagtataggcctgacgaaaataataagaaggataaagtgttatgcgttatcaagttcttaatcccactcaaccaaaggtaacaaggagattttactctggaagtcatactccgtagcacttcgatgtgttcttactgagactggtcacattagctgatagggtatatcaaaaaaaaaaaaaaa

SEQ ID NO: 1430 - protein, 347 aa, Arabidopsis thaliana
  G1461,NAC domain coordinates 37-163
MKVEDEATYELIKDELMKAEDEATYWLIKEELIKAEDDVIISRYLKRMIVNGDSWPDHFIEDVDVFNKNPNEEFHSQSPRFVIVKPRTENCGRTDGCQSGCWRIIGRDKLIKSKETGKILGFKKILKFCLKKKPREYKRSWVMEEYRLNNNLNCKQDHVICKIRFMFDAEISFLLAKHFSCLSTRSPLPANQLLPAYGVCFFDSEAEGAFYLETIIGYDGNTWPSYVTNDVYRLHPLTLVDPQDDKFKEFGTCIFANRTKTCGKTDECDGGGCWRIVEGHRVIKSKGKVLGYRRIFQFSENEEPRNVCEGEDPKKTAWFIEEYRPDENNKKDKVLCVIKFLIPLNQR

SEQ ID NO: 1431 - DNA, 1142 bp, Arabidopsis thaliana
  G1463,family:NAC
agtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgat

SEQ ID NO: 1432 - protein, 336 aa, Arabidopsis thaliana
  G1463,NAC domain coordinates 9-156
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 1433 - DNA, 1195 bp, Arabidopsis thaliana
  G1464,family:NAC
ccatgagtctcacttcttcttcgctctccaagaaacaaaacactcgatcttgcgtttgatctttctctctctatagatctttttcttgatcgattttatctcattatggaagataacgacgcagcttatgatcaagtcaaatccgaactgttaaactcagaagacgaagtaataatctcacgttatctgaagcctatggtcgttaacggagattcttggccagatcacttcatcgaagacgcaaacgtgttcaccaagaatccaaatgaggtgttcaattctgagagacctagattcgttatcgttaaaccacgaacagaggcttgtggtaagaccgatggatgtgaatctggttgctggaggaccatgggtcgtgataaactgataaagtcggaggagactgggaagattctagggttcaagaagattctcaagttttgcataaagtggaaacctatagaatacaagagaagttgggtaatggaagagtataggcttaccaataacttgaactggaagcaagatcatgtgatttgcaagattcggcttttgtttgaagcagaaattagtttcttgctagccaagcatttctacactacgtcagaatcacttcttcgacatgagctattgccatcttatggatatttatccaatacacaagaggaggatgaattttatctgaagacgataatgacttcggaaggaaacgattggcctagctacgttaccaacaacgtgtactgtcttcatccattggagcttgtggatcttcaagatgtgatgtttcaaagttacggaacctgcatcttcgctaacgggacttgtggtgaatctgataaatgcgatggtggttactggaagatcctgcacggtgataagctgatcaagtcaaatttcgggatggtcactggtttcaagaaggaagaaacagagaggttaggtcatcaacgttgccaaggcttgttgttgccacaccgtcgtggccatgtacaaaccaagagttgcggtgtcgtcaccgtgaaggagaagaggagtttggtagagcaaccggaggagattgtcgctgcacctgagacaccacgccaaggaaaaagtgagcataatgatccactaaagcgaaagaaagcgattggttgcgtgggagagaaagctgagatgtaggcgagacgtcaccactacgaatggagatgcggcc

SEQ ID NO: 1434 - protein, 351 aa, Arabidopsis thaliana
  G1464,NAC domain coordinates 12-160
MEDNDAAYDQVKSELLNSEDEVIISRYLKPMVVNGDSWPDHFIEDANVFTKNPNEVFNSERPRFVIVKPRTEACGKTDGCESGCWRTMGRDKLIKSEETGKILGFKKILKFCIKWKPIEYKRSWVMEEYRLTNNLNWKQDHVICKIRLLFEAEISFLLAKHFYTTSESLLRHELLPSYGYLSNTQEEDEFYLKTIMTSEGNDWPSYVTNNVYCLHPLELVDLQDVMFQSYGTCIFANGTCGESDKCDGGYWKILHGDKLIKSNFGMVTGFKKEETERLGHQRCQGLLLPHRRGHVQTKSCGVVTVKEKRSLVEQPEEIVAAPETPRQGKSEHNDPLKRKKAIGCVGEKAEM

SEQ ID NO: 1435 - DNA, 1066 bp, Arabidopsis thaliana
  G1465,family:NAC
ctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatc

SEQ ID NO: 1436 - protein, 320 aa, Arabidopsis thaliana
  G1465,NAC domain coordinates 242-306
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 1437 - DNA, 1342 bp, Arabidopsis thaliana
  G1466,family:PMR
caacaagcttcaaaaatgggggaagaagaagagaaccctaattcgatcgacattcttcccgagctacttgaagaagttctccttagattgcccacgaaatcgatcctcaaatgcagaatcgtctcaaaacaatggaggtcactcctggaatcgagtaggttcgcggagaggcatatgagtcttcaaaacagccgccggagaatcttagctgcttacaactgcgactgcggcggacggaggaagctcctacccgagtcacggtttgaaggggacgaagagattgtctatctgcactgcgacgcctcacgaccctcgatgacttgccaaggtgtgatctgcttccccgagcaagattggatcatcgttttgaacccatcgactagccaacttcggcgattcccttccggcttgaaccataactgcagatttagaattggattatggaagactttctctccgggaaactgggtaatggggtttggtagagacaaagtgaatgggaggtataaagtggtgaggatgtcttttgctttctggagagttaggcaagaggagcctgtggtggaatgtggtgttcttgatgttgatactggtgaatggcggaagctgagtccacctccttatgtggtcaatgtgggaagcaaatcggtatgcgtgaatggatctatctactggttacacattcagacggtttacagaatactagccttggatcttcacaaacaagagtttcataaagtcccagtgccgcctacgcagatcactgtggacactcagatggtgaaccttgaggaccgtctcgtacttgctataaccagagttagccctgaatggatactagaggtatggggcatggatacatacaaagaaaaatggagcaagacttactccataagtttggatcatagagttgtttcctggcgaaggcagaaaaggtggttcacgcccgtggcagtttctaagcaagcgaatcttgtcttctatgacaataagaagaggctattcaaatattatccagtgaaagatgagattcgttgtctctccttagacatttgtgttctgtctccttacgtggaaaacttggtccctcttccgttaaagccaagccatccgcatcctactccgaaaaattcagattttgaaatgaggatatcaagatgccgcttgttttcgacgccaggttcttggatatccaaaattttgaaatggaatgttatgactctagagattttgtttacctctctagcaatagttggttatatatgcttacctctctaggagttatttatcttgtttcaaaatattagttggttatatatgctttcgagatctttctgataaa

SEQ ID NO: 1438 - protein, 420 aa, Arabidopsis thaliana
  G1466,PMR domain coordinates 154-420
MGEEEENPNSIDILPELLEEVLLRLPTKSILKCRIVSKQWRSLLESSRFAERHMSLQNSRRRILAAYNCDCGGRRKLLPESRFEGDEEIVYLHCDASRPSMTCQGVICFPEQDWIIVLNPSTSQLRRFPSGLNHNCRFRIGLWKTFSPGNWVMGFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 1439 - DNA, 1131 bp, Arabidopsis thaliana
  G1482,family:Z-CO-like
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 1440 - protein, 331 aa, Arabidopsis thaliana
  G1482,Z-CO-like domain coordinates 2-33,60-102
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 1441 - DNA, 1047 bp, Arabidopsis thaliana
  G1489,family:GATA/Zn
cacaaccccaaaaatagacctcacctctctcgtcttctctattctctccgctccttaatttccaattccaaccttctctgttttgccttgatggaaaagatagctccggagctcttcctcgtcgccggtaacccggactctttcgtcgtcgacgacctcctcgacttctctaacgacgacggcgaagttgacgacggcttaaacactcttcccgattcttcaacactctccaccggcactctcaccgacagttccaactcctcctcgcttttcaccgacggcactggcttctccgacctatatattccgaatgacgatatagcagaattagaatggttatcaaattttgtggaagaatcattcgcaggagaagaccaagacaagcttcacttattttccggtttaaaaaaccctcaaaccaccgggtcgaccctgacccacttaattaaacccgaacccgaacttgatcatcaattcatcgacatcgatgaatccaacgtcgccgttcctgccaaggccagaagcaagagatcacgttctgcagcctccacgtgggcttcccgtcttttatccttagccgattccgacgaaaccaatcccaagaagaaacaacgaagagtgaaagaacaagacttcgccggagatatggacgtggattgcggagaaagcggaggaggacgacgttgtttgcactgcgcgacggagaagacgccgcaatggaggacgggacctatgggtccgaagacgctttgtaacgcttgcggagtgaggtacaaatcagggaggctcgtgccggagtatagaccggcgtcgagtccgacgttcgtgatggcgaggcactcgaactctcaccggaaagtgatggagctccggcgacagaaggagatgagagacgagcatttgctgagtcagcttaggtgtgagaatctactgatggatatcagatccaacggtgaagatttcttaatgcataataatactaaccacgtggctcctgattttagacacttaatctagttttctatttccacgtggataatttcgcaa

SEQ ID NO: 1442 - protein, 308 aa, Arabidopsis thaliana
  G1489,GATA/Zn domain coordinates 199-225
MEKIAPELFLVAGNPDSFVVDDLLDFSNDDGEVDDGLNTLPDSSTLSTGTLTDSSNSSSLFTDGTGFSDLYIPNDDIAELEWLSNFVEESFAGEDQDKLHLFSGLKNPQTTGSTLTHLIKPEPELDHQFIDIDESNVAVPAKARSKRSRSAASTWASRLLSLADSDETNPKKKQRRVKEQDFAGDMDVDCGESGGGRRCLHCATEKTPQWRTGPMGPKTLCNACGVRYKSGRLVPEYRPASSPTFVMARHSNSHRKVMELRRQKEMRDEHLLSQLRCENLLMDIRSNGEDFLMHNNTNHVAPDFRHLI

SEQ ID NO: 1443 - DNA, 820 bp, Arabidopsis thaliana
  G149,family:MADS
gagtggaaaatcaaaatactgttgttgattagggttaattaaattagaagaatggtgaggggaaagacagagatgaagaggatagagaacgcaacgagcaggcaagtgactttctcaaaaagaagaaatggacttttgaagaaagcttttgaattatcagtcctttgtgatgctgaagttgccctaatcatcttctctcctagaggcaaactctatgagttctctagctcctccagtatacctaaaacagtagaaagatatcaaaagcgaatacaagatctcgggtctaaccataagagaaatgataattcacagcaatcgaaggacgaaacctatggcttggcgagaaagatcgaacatttggagatttcgacacgaaaaatgatgggagaaggacttgacgcatcttctatagaagagttacaacaattggagaaccagttggacagaagcttaatgaaaataagagccaaaaagtaccagttattacgagaagaaactgagaaattaaaagaaaaggagaggaacctcattgcagaaaataaaatgctgatggagaagtgtgagatgcaaggaagaggaataataggaagaatatcatcatcatcatcaacatcagaactggatatagatgacaatgaaatggaagtggtgactgatttgttcattggacctcctgagactcgacacttcaaaaagtttcctccttcaaactaacatatatagtacaatgcttatatagatattatgtagggaattacttttttccctgaagaaaaattgatgttacttactgaatttagcagttgcataaaaaaaa

SEQ ID NO: 1444 - protein, 221 aa, Arabidopsis thaliana
  G149,MADS domain coordinates 2-57
MVRGKTEMKRIENATSRQVTFSKRRNGLLKKAFELSVLCDAEVALIIFSPRGKLYEFSSSSSIPKTVERYQKRIQDLGSNHKRNDNSQQSKDETYGLARKIEHLEISTRKMMGEGLDASSIEELQQLENQLDRSLMKIRAKKYQLLREETEKLKEKERNLIAENKMLMEKCEMQGRGIIGRISSSSSTSELDIDDNEMEVVTDLFIGPPETRHFKKFPPSN

SEQ ID NO: 1445 - DNA, 1069 bp, Arabidopsis thaliana
  G1492,family:GARP
aatcccaacccacacacctctcaaatcctcctctcctcgtttctctttctctcctcttcacagaaccaaaacatatcaaacctttttttctcttgggtttaagtaaaaatcgaatctttgtgtcggtttttagggttcttgaaacgatatgggtaagtctagtggtagaaatggtaacggaagctttaacggcaataaatttcacggagttagaccttacgtacggtctccagttccacggcttagatggacgccggatcttcaccgttgtttcgttcacgccgtcgagattctcggtggtcaacaccgagcaacaccaaaacttgttcttaagatgatggatgtgaagggacttaccatttcacatgtcaaaagccaccttcagatgtatagaggaggttcaaagctcactttggagaaaccagaagaaagctcatcatcttcaataagaagaagacaagacagtgaagaagattattatcttcatgacaacttgtctttacacacaaggaatgattgtcttttgggttttcactcttttcctctttcttcacattcttcatttagaggaggaggaggaggaagaacaaaagagcagcagacttcagagtctggtggttatgatgatgatgctgactttcttcacatcaagaagatgaacgatacgacgacgtttttgtcacatcatttccccaagggaacagaggagtggcgggaacaagaacacgaagaagaagaagaagatttgtcgttgtctctgtcgttaaatcatcatcattggagaagcaatggatcatcggtggtgagcgaaacgagtgaagcagcagtctcgacttgttcagcaccattcgtatccaaagattgctttggttcttcaaagattgatcttaatctgtcaatttctctcctcggtagctaaataagttatgcaagatttaggttcagagaaactattcggatgtgtttttgaaactaggatattgaatgttagtagagaaacctagaaaatgaagtttagataaattatcaacgcagcgttttgatcgcctttgaacggaaaattaacaaa

SEQ ID NO: 1446 - protein, 256 aa, Arabidopsis thaliana
  G1492,GARP domain coordinates 34-83
MGKSSGRNGNGSFNGNKFHGVRPYVRSPVPRLRWTPDLHRCFVHAVEILGGQHRATPKLVLKMMDVKGLTISHVKSHLQMYRGGSKLTLEKPEESSSSSIRRRQDSEEDYYLHDNLSLHTRNDCLLGFHSFPLSSHSSFRGGGGGRTKEQQTSESGGYDDDADFLHIKKMNDTTTFLSHHFPKGTEEWREQEHEEEEEDLSLSLSLNHHHWRSNGSSVVSETSEAAVSTCSAPFVSKDCFGSSKIDLNLSISLLGS

SEQ ID NO: 1447 - DNA, 2090 bp, Arabidopsis thaliana
  G1493,family:GARP
cttgggttcgagctacatagagagaggtatgatgaatccgagtcacggaagaggactcggatcggctggtgggtccagctccggtagaaatcaaggaggtggtggtgagaccgtcgtcgagatgtttccttctggtcttcgagttcttgtcgttgacgatgacccaacttgtctcatgatcttagagaggatgcttaggacttgtctttacgaagtaacgaaatgcaacagagcagagatggcattgtctctgctccggaagaacaaacatggattcgatatagtaatcagtgatgttcatatgcctgacatggacggtttcaagcttcttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggtttgatttgatttttttttttttttgtcaaacttatatagaagcataatctgatccg

SEQ ID NO: 1448 - protein, 669 aa, Arabidopsis thaliana
  G1493,GARP domain coordinates 242-289
MMNPSHGRGLGSAGGSSSGRNQGGGGETVVEMFPSGLRVLVVDDDPTCLMILERMLRTCLYEVTKCNRAEMALSLLRKNKHGFDIVISDVHMPDMDGFKLLEHVGLEMDLPVIMMSADDSKSVVLKGVTHGAVDYLIKPVRMEALKNIWQHVVRKRRSEWSVPEHSGSIEETGERQQQQHRGGGGGAAVSGGEDAVDDNSSSVNEGNNWRSSSRKRKDEEGEEQGDDKDEDASNLKKPRVVWSVELHQQFVAAVNQLGVEKAVPKKILELMNVPGLTRENVASHLQKYRIYLRRLGGVSQHQGNLNNSFMTGQDASFGPLSTLNGFDLQALAVTGQLPAQSLAQLQAAGLGRPAMVSKSGLPVSSIVDERSIFSFDNTKTRFGEGLGHHGQQPQQQPQMNLLHGVPTGLQQQLPMGNRMSIQQQIAAVRAGNSVQNNGMLMPLAGQQSLPRGPPPMLTSSQSSIRQPMLSNRISERSGFSGRNNIPESSRVLPTSYTNLTTQHSSSSMPYNNFQPELPVNSFPLASAPGISVPVRKATSYQEEVNSSEAGFTTPSYDMFTTRQNDWDLRNIGIAFDSHQDSESAAFSASEAYSSSSMSRHNTTVAATEHGRNHQQPPSGMVQHHQVYADGNGGSVRVKSERVATDTATMAFHEQYSNQEDLMSALLKQV

SEQ ID NO: 1449 - DNA, 1023 bp, Arabidopsis thaliana
  G1507,family:GATA/Zn
aattagctctgcaaaggctcttcattcttctcgcttggattcctctgcacaaaagaaaaaagaccatggatgatcttcatggaagaaatggtcgaatgcacattggtgtagcgcaaaatccaatgcatgtgcagtatgaagatcacggtttgcaccatatcgacaatgaaaacagtatgatggatgaccatgctgatggtgggatggatgaaggagtggagacagacattccttctcaccctggaaactcagctgataatcgtggtgaagttgtagaccgtggaattgaaaatggagatcaattgacattgtccttccagggacaagtttatgtttttgaccgtgtctcgcctgagaaggttcaagctgtgcttttgttacttggtggaagggaagtaccacatacactcccaacaaccctaggatcacctcatcagaacaatagggtactgggtctatctggtactcctcaacggcttagcgttccgcagcggttagcttctttgctcaggtttagggagaaacgaaaagggaggaactttgataagactattcgctatacagtcaggaaagaagtagccttgagaatgcagcgtaagaaaggtcagttcacgtcggctaaatcaagcaatgatgattctggatccactggatcggattgggggtcaaaccagagctgggccgtagaagggactgagactcagaagccagaggttttatgtcgacactgtggaacaagtgagaagtcaactccaatgatgcgacgtggacctgatgggccaagaacactttgtaatgcgtgtggactgatgtgggcaaacaaggggactcttagagacctatccaaagtccctcctccgcaaacacctcagcatctatctctgaataagaatgaggacgcaaatcttgaggctgatcaaatgatggaagtaactggtgacattagcaacacacagtgagaactgagaaaccattggaagcaagaaaggatctcaaacaaaaacagttgttatcatttcattt

SEQ ID NO: 1450 - protein, 297 aa, Arabidopsis thaliana
  G1507,GATA/Zn domain coordinates 219-247
MDDLHGRNGRMHIGVAQNPMHVQYEDHGLHHIDNENSMMDDHADGGMDEGVETDIPSHPGNSADNRGEVVDRGIENGDQLTLSFQGQVYVFDRVSPEKVQAVLLLLGGREVPHTLPTTLGSPHQNNRVLGLSGTPQRLSVPQRLASLLRFREKRKGRNFDKTIRYTVRKEVALRMQRKKGQFTSAKSSNDDSGSTGSDWGSNQSWAVEGTETQKPEVLCRHCGTSEKSTPMMRRGPDGPRTLCNACGLMWANKGTLRDLSKVPPPQTPQHLSLNKNEDANLEADQMMEVTGDISNTQ

SEQ ID NO: 1451 - DNA, 420 bp, Arabidopsis thaliana
  G1508,family:GATA/Zn
atgctagatcacagtgaaaaggtcttattggttgattcagaaaccatgaaaacaagagctgaagatatgatcgaacagaacaacactagtgttaacgacaagaagaagacttgtgctgattgtggaaccagtaaaactcctctttggcgtggtggtcctgttggtccaaagtcgttgtgtaacgcgtgtgggatcagaaacagaaagaagagaagaggaggaacagaagataataagaaattaaagaaatcgagttctggcggcggaaaccgtaaatttggtgaatcgttaaaacagagtttgatggatttggggataaggaagagatcaacggtggagaagcaacgacagaagcttggtgaagaagaacaagccgctgtgttactcatggctctttcttatggctctgtttacgcttag

SEQ ID NO: 1452 - protein, 139 aa, Arabidopsis thaliana
  G1508,GATA/Zn domain coordinates 38-63
MLDHSEKVLLVDSETMKTRAEDMIEQNNTSVNDKKKTCADCGTSKTPLWRGGPVGPKSLCNACGIRNRKKRRGGTEDNKKLKKSSSGGGNRKFGESLKQSLMDLGIRKRSTVEKQRQKLGEEEQAAVLLMALSYGSVYA

SEQ ID NO: 1453 - DNA, 1533 bp, Arabidopsis thaliana
  G1509,family:GATA/Zn
atggggaagcaaggaccttgctaccactgtggagttacaaacacacctttgtggagaaatggaccaccagagaagccggtattgtgcaatgcgtgtggatcgcgttggaggacaaagggaacacttgtgaactacacaccgcttcatgctcgtgctgatggtgatgagaatgatgatcatcacaggtttcaaagaatgaagagcatttctttaggcaataagaacaaagagataaagatgctcaagaggaaagcaattcaagaaaacatcatcattaaaagaccggtctttgaattcagttatggtttgaaggcggctgtgatagaggaggatgctagtaatagatcgagttccggttcggctgtatcaaactctgagagctgtgcacagtttagcagtgcagatgggagtccatctcaatctaatgcgtgggacacaactgttccttgcaagaggaggacgtgtgtgggccgtcctaagtcctcttctgttgaaaagctcacaaaggacctttacaatattttacaagagcagcaatcgtcatgtctctcagtttcatcagaggaagatcttctttttgagaatgaaatgtcaatggtctcagttgagattggacatgggagtgttctgatgaagaatccccactcgtttgctcgggaagaggagtctgaagccagctcactctcttcgattgagaacaagtcctccatcagtgacgcatactcacattccgtgaagcgtgttgagattggagcagtgagaggttcatattatggtggacaaacaataaagcaagaacaattcaagagaaccaagtctcaaactgaaagagtgcatgtcctggggagtcatggttcaccactatgtagcatagatttgaaggatgttttcaactttgatgagttcatagaacaattcacagaggaagaacagaagaaactgatgaacttgcttcctcagattgactctgatgaccttcctcatagcctcagaatgatgtttgaaagtgctcagttcaaggacaacttctctttgtttcagcagctcattgctgatggtgtctttgatgtgtcttcttcctcgggggcaaaactcgaagaaatcaggacttttaagaagcttgctttgacagattttaacaaatctcgtttggtggaaagctataacctcctcaaggaacgcgaaaaagggaccggagattctgttactacaacttcaaaaagctcaatcccaaatgtacctaaaaatattgtaaccattaagaggcgctatgaaaaccaaatccaagtaaagtcagagtcaagggggctaatgaggagccccaaaagggtgatgaagatgaaagcaagccatgagacagagaacaatgtctcatgcttcagaccaagaagcttggcttctgtgtttgcacaagaaggtggctctgcagtgtttagctatgaaggtaattgcagttctgatcaagatctccttcttctggacttgccgtcaaacgggtcatttcctcaagcagagctacttcaccaactctga

SEQ ID NO: 1454 - protein, 510 aa, Arabidopsis thaliana
  G1509,GATA/Zn domain coordinates NA
MGKQGPCYHCGVTNTPLWRNGPPEKPVLCNACGSRWRTKGTLVNYTPLHARADGDENDDHHRFQRMKSISLGNKNKEIKMLKRKAIQENIIIKRPVFEFSYGLKAAVIEEDASNRSSSGSAVSNSESCAQFSSADGSPSQSNAWDTTVPCKRRTCVGRPKSSSVEKLTKDLYNILQEQQSSCLSVSSEEDLLFENEMSMVSVEIGHGSVLMKNPHSFAREEESEASSLSSIENKSSISDAYSHSVKRVEIGAVRGSYYGGQTIKQEQFKRTKSQTERVHVLGSHGSPLCSIDLKDVFNFDEFIEQFTEEEQKKLMNLLPQIDSDDLPHSLRMMFESAQFKDNFSLFQQLIADGVFDVSSSSGAKLEEIRTFKKLALTDFNKSRLVESYNLLKEREKGTGDSVTTTSKSSIPNVPKNIVTIKRRYENQIQVKSESRGLMRSPKRVMKMKASHETENNVSCFRPRSLASVFAQEGGSAVFSYEGNCSSDQDLLLLDLPSNGSFPQAELLHQL

SEQ ID NO: 1455 - DNA, 959 bp, Arabidopsis thaliana
  G152,family:MADS
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 1456 - protein, 227 aa, Arabidopsis thaliana
  G152,MADS domain coordinates 2-57
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 1457 - DNA, 1098 bp, Arabidopsis thaliana
  G153,family:MADS
aaaaaaaagaagcttctcctcttcctctgccttcttctttccatttattgcaaaccctgatcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatacgaaaagagtttgtatgtcatcttcagtaacaaccaagctggatcatttcattcttggttatgtaattctgtttactactttggagtttaatatgttatatgacaagtttctctttgtcaagttacttgtgtatgtacatcataaaataatgatgtgatgtgagtgccgaacatactagacatcattttaccgtgtgtttttttcgggtacattaaatgtacaaaatccagtctaattggcatttttatacaaaaaaaaaaaaaaaaaa

SEQ ID NO: 1458 - protein, 234 aa, Arabidopsis thaliana
  G153,MADS domain coordinates 1-57
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 1459 - DNA, 766 bp, Arabidopsis thaliana
  G1545,family:HB
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 1460 - protein, 220 aa, Arabidopsis thaliana
  G1545,HB domain coordinates 54-117
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 1461 - DNA, 2511 bp, Arabidopsis thaliana
  G1548,family:HB
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 1462 - protein, 836 aa, Arabidopsis thaliana
  G1548,HB domain coordinates 17-77
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 1463 - DNA, 2232 bp, Arabidopsis thaliana
  G1588,family:HB
atgtaccatccaaacatgtttgagagccatcatatgttcgatatgaccccaaagagtacctctgataacgacttgggaatcaccggtagccgagaagatgactttgagaccaagtcaggtaccgaagtcactactgagaatccttctggtgaagagcttcaagatcctagccaacgtcccaacaaaaagaagcgttaccatcgccacacgcaacgccaaattcaagagctcgaatcattctttaaggaatgtcctcatccagatgataagcaacgaaaagagttgagccgtgatctcaatttagagcctcttcaagttaagttttggttccaaaacaaacgcacacagatgaaggcacaaagtgagaggcatgagaaccagattctaaagtcagacaatgacaagctcagagcagagaacaatagatacaaagaagctctaagcaatgctacatgccctaactgtggcggtccagctgctattggagaaatgtcttttgacgaacaacatctcaggatcgaaaatgctcggctccgcgaagagattgataggatctctgctattgctgcgaaatacgttgggaagccgttaggatcgtctttcgctccactagcgatccacgcgccttctcgttcgcttgatcttgaagttggaaactttgggaaccagacaggctttgtaggagaaatgtatggaacaggggacattttgaggtcagtttcgattccttctgagactgataagcctataatcgtggagctagcggttgcagctatggaggaactcgtgagaatggctcaaactggagatcctttatggctttcaaccgataattcagtcgagattctcaacgaagaagagtatttcagaacgtttccgagaggaattggaccaaagccattaggattaagatcagaggcgtcaagacaatctgcagttgttataatgaatcacatcaatctcgttgagattctcatggatgtgaatcaatggtcttgtgttttctctgggattgtgtcaagagccttgacacttgaagttctttcaactggagttgctgggaactacaacggtgctttacaagtgatgacagctgagtttcaagttccatcacccctagtcccaacgcgtgagaactactttgtgagatactgcaaacaacacagtgacggctcttgggctgtggttgatgtctctttggacagccttagaccaagtactccaatcttaagaactagaagaaggccttcaggttgtctgattcaagaattgcctaatggttattctaaggttacatggatagagcatatggaggtagatgatagatcagttcacaacatgtataaaccgttggttcagtccggtttagctttcggtgcgaaacgttgggtggctacactcgaacgacaatgcgagcggcttgctagctccatggccagcaacattcctggtgatctttccgtgataacgagtcctgaaggaaggaagagtatgttgaagctagctgagagaatggttatgagtttctgcagtggtgttggcgcgtcgactgcacacgcttggacaacaatgtcgacaacaggatccgatgatgttcgggtcatgacccgcaagagtatggatgatccaggaagacctccgggtattgttcttagtgcagctacttcattctggatcccagttgctcccaaacgtgtttttgatttcctccgtgacgaaaattcaagaaaagagtgggatattctgtcaaatggaggtatggttcaggaaatggctcatatagccaatggtcatgaacctggaaactgtgtctccttgctccgagtcaatagtggaaactcgagccagagcaacatgttgattctacaagagagctgtacagatgcatcaggatcgtatgtgatttacgcgccagtggatatagtggcgatgaatgtggttctaagcggtggagatcctgattacgtggcgttgttgccgtctggttttgctattttaccggatggttcggttggaggaggagatgggaatcagcatcaggaaatggtttctactacttcttctgggagttgtggtggttcgcttttaaccgttgcgtttcagattcttgttgactctgttcctacagctaaactctcacttggctcggtggctacggttaatagtctgatcaaatgtacggtggagaggattaaagctgctgtttcttgtgatgttggaggaggagcgtag

SEQ ID NO: 1464 - protein, 743 aa, Arabidopsis thaliana
  G1588,HB domain coordinates 66-124
MYHPNMFESHHMFDMTPKSTSDNDLGITGSREDDFETKSGTEVTTENPSGEELQDPSQRPNKKKRYHRHTQRQIQELESFFKECPHPDDKQRKELSRDLNLEPLQVKFWFQNKRTQMKAQSERHENQILKSDNDKLRAENNRYKEALSNATCPNCGGPAAIGEMSFDEQHLRIENARLREEIDRISAIAAKYVGKPLGSSFAPLAIHAPSRSLDLEVGNFGNQTGFVGEMYGTGDILRSVSIPSETDKPIIVELAVAAMEELVRMAQTGDPLWLSTDNSVEILNEEEYFRTFPRGIGPKPLGLRSEASRQSAVVIMNHINLVEILMDVNQWSCVFSGIVSRALTLEVLSTGVAGNYNGALQVMTAEFQVPSPLVPTRENYFVRYCKQHSDGSWAVVDVSLDSLRPSTPILRTRRRPSGCLIQELPNGYSKVTWIEHMEVDDRSVHNMYKPLVQSGLAFGAKRWVATLERQCERLASSMASNIPGDLSVITSPEGRKSMLKLAERMVMSFCSGVGASTAHAWTTMSTTGSDDVRVMTRKSMDDPGRPPGIVLSAATSFWIPVAPKRVFDFLRDENSRKEWDILSNGGMVQEMAHIANGHEPGNCVSLLRVNSGNSSQSNMLILQESCTDASGSYVIYAPVDIVAMNVVLSGGDPDYVALLPSGFAILPDGSVGGGDGNQHQEMVSTTSSGSCGGSLLTVAFQILVDSVPTAKLSLGSVATVNSLIKCTVERIKAAVSCDVGGGA

SEQ ID NO: 1465 - DNA, 984 bp, Arabidopsis thaliana
  G1594,family:HB
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 1466 - protein, 327 aa, Arabidopsis thaliana
  G1594,HB domain coordinates 308-343
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 1467 - DNA, 1015 bp, Arabidopsis thaliana
  G16,family:AP2
ctgtctctcactttccttcattatttactcattgcccaaaataattcatttatcatatcctcaaacttttttttttctatacctcgaaatccaaaaaaataaatacattggtttagtgtggcattgatgtttttggtataaagctcttcaccaatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtataattattaagtcataatcataaaaatatactagtaatgctgtgtttaataattactttttaatgacccctttattttgtatagggcggctttaggtttatttgtctttgaatcttcttttctcaatttgtgggtgtgagagagctcgatatatgaatacttgtacatacttctcataacatgtgttttttttttcttaataaatgtggaaactt

SEQ ID NO: 1468 - protein, 218 aa, Arabidopsis thaliana
  G16,AP2 domain coordinates 33-100
MIASESTKSWEASAVRQENEEEKKKPVKDSGKHPVYRGVRKRNWGKWVSEIREPRKKSRIWLGTFPSPEMAARAHDVAALSIKGASAILNFPDLAGSFPRPSSLSPRDIQVAALKAAHMETSQSFSSSSSLTFSSSQSSSSLESLVSSSATGSEELGEIVELPSLGSSYDGLTQLGNEFIFSDSADLWPYPPQWSEGDYQMIPASLSQDWDLQGLYNY

SEQ ID NO: 1469 - DNA, 928 bp, Arabidopsis thaliana
  G164,family:MADS
aaatacacaaaagaaaaagataagagatatgagggggaagatgaagttatcgttcatagaaaatgattcagtgaggaaaacaacattcaccaaaaggaagaaagggatgctgaagaaattcaacgagctagtaactctatgtggtgttgacgcatgtgcggtcatccgtagcccgtacaactcgatccaggagccttggccatcaagggaaggcgttgaagaagtgatgtcgaagtttatggagttttcggtgttggaccggaccaagaagatggtggatcaagagacgtttttacgtcaaaggatcgccaaagaaacagaacgtctccagaagctacgtgatgagaaccgtaattctcagattcgagatttaatgtttggttgtctcaaaggagaggtggacgtgtctcatcttcatggaagagatcttcttgatttgaatgtatttcttaacaagtatctcaatggtgttattcgtagggttgagatccttaaggagaacggtgagtcttcttcatctgtacctcctcctattggtgtagctcctactgttgtggatgcatctgtcccaatcggttttgatggtcgtatgattcaagatcaaaaccaaaatcagcaagagccggttcaattccaataccaggctctttatgatttttatgatcagattccaaagaaacttcatgattttaacatgaaaatgaatatagatccaaatcagagtatgaatttggatcttaatgatggagaggacgagggcattccttgcatggacaacaacaactaccaccccgaaatcgattgtctcgctaccgtcaccactgcccccactgatgtttgtgctcctaacatcatcaatgatctctagtcgaagggatgtatttcgagtgaagtggttgatcatctgcatcttttgatttttccattt

SEQ ID NO: 1470 - protein, 279 aa, Arabidopsis thaliana
  G164,MADS domain coordinates NA
MRGKMKLSFIENDSVRKTTFTKRKKGMLKKFNELVTLCGVDACAVIRSPYNSIQEPWPSREGVEEVMSKFMEFSVLDRTKKMVDQETFLRQRIAKETERLQKLRDENRNSQIRDLMFGCLKGEVDVSHLHGRDLLDLNVFLNKYLNGVIRRVEILKENGESSSSVPPPIGVAPTVVDASVPIGFDGRMIQDQNQNQQEPVQFQYQALYDFYDQIPKKLHDFNMKMNIDPNQSMNLDLNDGEDEGIPCMDNNNYHPEIDCLATVTTAPTDVCAPNIINDL

SEQ ID NO: 1471 - DNA, 867 bp, Arabidopsis thaliana
  G1641,family:MYB-related
atggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatag

SEQ ID NO: 1472 - protein, 288 aa, Arabidopsis thaliana
  G1641,MYB-related domain coordinates 32-82,141-189
MEVMRPSTSHVSGGNWLMEETKSGVAASGEGATWTAAENKAFENALAVYDDNTPDRWQKVAAVIPGKTVSDVIRQYNDLEADVSSIEAGLIPVPGYITSPPFTLDWAGGGGGCNGFKPGHQVCNKRSQAGRSPELERKKGVPWTEEEHKLFLMGLKKYGKGDWRNISRNFVITRTPTQVASHAQKYFIRQLSGGKDKRRASIHDITTVNLEEEASLETNKSSIVVGDQRSRLTAFPWNQTDNNGTQADAFNITIGNAISGVHSYGQVMIGGYNNADSCYDAQNTMFQL

SEQ ID NO: 1473 - DNA, 1564 bp, Arabidopsis thaliana
  G1664,family:HLH/MYC
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 1474 - protein, 450 aa, Arabidopsis thaliana
  G1664,HLH/MYC domain coordinates 260-317
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 1475 - DNA, 1537 bp, Arabidopsis thaliana
  G1672,family:NAC
gatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggaga

SEQ ID NO: 1476 - protein, 386 aa, Arabidopsis thaliana
  G1672,NAC domain coordinates 41-194
MKNSKCNLIDSKLEEHHHLCGSKHCPGCGRMIQAATKPNWVGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHLGINEEEREGELVVSKIFYQTQPRQCVSNTNWSDHHGSKDVIGIGVGDEISSVAATLQSLGSGDVVSRVNMHPHTRSFDEGTAEASKGRENQHVSGTCEEVHDGIITSSMSSHHMIHDHHNQHHQIGDRREFHMSSSYPMTPTITSQHESIFHVTSTMPFQRQQLRGRSSGSGLEDLIMGCTTATCTEDNNHK

SEQ ID NO: 1477 - DNA, 1107 bp, Arabidopsis thaliana
  G170,family:MADS
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 1478 - protein, 368 aa, Arabidopsis thaliana
  G170,MADS domain coordinates 2-57
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 1479 - DNA, 1034 bp, Arabidopsis thaliana
  G1748,family:AP2
aacgagagattttttatatataaaaaataaaggaagcacgagttcaccttaaaaatttgagtttctcttttcttgaccctgaagtttcgttttgatcaatttcacccatttctttgttcgtcgtcttttctttcaaaagggtttcatctttgtattataaaaatccaaactttatatcttcacaagcagcaaagatctctatttcaatcctctcatggaaactgcttctctttctttccctgtcccaaacacgagcttcggtgtaaacaaatctatgcctctcggtctaaaccagctcacaccataccaaattcatcagattcagaaccagcttaaccatagacgtagcacaatctcaaacctctctccaaaccgtatcagaatgaagaacttaacaccttctacctccaaaaccaagaatctctacagaggcgtaaggcaaaggcactgggggaaatgggtcgctgagatccgtttgcccaagaaccggacccgtctctggctcgggacattcgaaaccgccgaaaaagccgccttagcttacgaccaagctgcttttcagctccgtggagatatcgcgaagcttaacttcccaaacctcatacacgaagacatgaatcctctcccttcctctgttgataccaagcttcaagctatctgcaaaagtttgagaaaaacagaggaaatttgctctgtttctgatcaaacaaaggagtactctgtttactctgtttcagataaaacagagcttttcctgccaaaagcagagcttttcttgcctaaaagagagcatttggagacaaatgagctctctaatgagtcaccgagaagcgatgagacctcgttgttggatgagtcgcaggcggaatattcatcgtcggataaaacattcctggatttctcggatactgagtttgaagagattggaagtttcgggcttcggaagtttccttcggtggagattgattgggatgcaattagtaaactggccaattcttaaagtcttctattttatattaatcttctgtgcaact

SEQ ID NO: 1480 - protein, 261 aa, Arabidopsis thaliana
  G1748,AP2 domain coordinates 68-135
METASLSFPVPNTSFGVNKSMPLGLNQLTPYQIHQIQNQLNHRRSTISNLSPNRIRMKNLTPSTSKTKNLYRGVRQRHWGKWVAEIRLPKNRTRLWLGTFETAEKAALAYDQAAFQLRGDIAKLNFPNLIHEDMNPLPSSVDTKLQAICKSLRKTEEICSVSDQTKEYSVYSVSDKTELFLPKAELFLPKREHLETNELSNESPRSDETSLLDESQAEYSSSDKTFLDFSDTEFEEIGSFGLRKFPSVEIDWDAISKLANS

SEQ ID NO: 1481 - DNA, 755 bp, Arabidopsis thaliana
  G1749,family:AP2
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 1482 - protein, 158 aa, Arabidopsis thaliana
  G1749,AP2 domain coordinates 84-152
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 1483 - DNA, 1089 bp, Arabidopsis thaliana
  G1753,family:AP2
acccaaaaaaacgcgatatccaacaagaggagcaattaaaaagctgtctttacagctttagcttcatcatctctaagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgtaatataaggtcgtactgtattaagtttttgtctttaaattattctcaatttacaatcttatctagtctgatgtaatgccaaatgtaatgaatagtcaatgccttgactgatactcatttgtttattttacagatggatacaatttt

SEQ ID NO: 1484 - protein, 184 aa, Arabidopsis thaliana
  G1753,AP2 domain coordinates 12-80
MQGTSKDNGGRHPLYRGVRQRKNSNKWVSEIREPRKPNRIWLGTFSTPEMAAIAYDVAALALKGSQAELNFPNSVSSLPAPTSMSPADIQAAAASAAAAFGAARDAIVMANNNSQTSGVACMNSSYDNTNMNGFMDEDLVFDMPNVLMNMAEGMLLSPPRPTVFDAAYDADGFPGGDDYLWNFP

SEQ ID NO: 1485 - DNA, 1393 bp, Arabidopsis thaliana
  misc_feature (1385)..(1385): n is a, c, g, or t
  G1754,family:AP2
aacctttctcttctctgctaacgagaaaacaaaagctatcgtctttgctactactactactactattattacattgaatcctttgtgttcttcttcttcagctgctactttgttcgagtgctttcttacatgccgtcggagattgttgacaggaaaaggaagtctcgtggaacacgagatgtagctgagattctaaggcaatggagagagtacaatgagcagattgaggcagaatcttgtatcgatggtggtggtccaaaatcaatccgaaagcctcctccaaaaggttcgaggaagggttgtatgaaaggtaaaggtggacctgaaaacgggatttgtgactatagaggagttagacagaggagatggggtaaatgggttgctgagatccgtgagccagacggaggtgctaggttgtggctcggtactttctccagttcatatgaagctgcattggcttatgacgaggcggccaaagctatatatggtcagtctgccagactcaatcttcccgagatcacaaatcgctcttcttcgactgctgccactgccactgtgtcaggctcggttactgcattttctgatgaatctgaagtttgtgcacgtgaggatacaaatgcaagttcaggttttggtcaggtgaaactagaggattgtagcgatgaatatgttctcttagatagttctcagtgtattaaagaggagctgaaaggaaaagaggaagtgagggaagaacataacttggctgttggttttggaattggacaggactcgaaaagggagactttggatgcttggttgatgggaaatggcaatgaacaagaaccattggagtttggtgtggatgaaacgtttgatattaatgagctattgggtatattaaacgacaacaatgtgtctggtcaagagacaatgcagtatcaagtggatagacacccaaatttcagttaccaaacgcagtttccaaattctaacttgctcgggagcctcaaccctatggagattgctcaaccaggagttgattatggatgtccttatgtgcagcccagtgatatggagaactatggtattgatttagaccatcgcaggttcaatgatcttgacatacaggacttggattttggaggagacaaagatgttcatggatctacataagatttcaaatttcgtttgactggcctaagtttgtgattctgctccgagacggtgtagctgttactagctagaagctgcccttctttgaagctactgatactttctgatattaatggttgtgagacgtagtacatgtagttaggtaatgtaggacaagttcaaatatgattccttctttctttttcttgtgaatacatatgacatatgaagaagttcaaacgttgggtttnaaaaaaaa

SEQ ID NO: 1486 - protein, 341 aa, Arabidopsis thaliana
  G1754,AP2 domain coordinates 69-136
MPSEIVDRKRKSRGTRDVAEILRQWREYNEQIEAESCIDGGGPKSIRKPPPKGSRKGCMKGKGGPENGICDYRGVRQRRWGKWVAEIREPDGGARLWLGTFSSSYEAALAYDEAAKAIYGQSARLNLPEITNRSSSTAATATVSGSVTAFSDESEVCAREDTNASSGFGQVKLEDCSDEYVLLDSSQCIKEELKGKEEVREEHNLAVGFGIGQDSKRETLDAWLMGNGNEQEPLEFGVDETFDINELLGILNDNNVSGQETMQYQVDRHPNFSYQTQFPNSNLLGSLNPMEIAQPGVDYGCPYVQPSDMENYGIDLDHRRFNDLDIQDLDFGGDKDVHGST

SEQ ID NO: 1487 - DNA, 1410 bp, Arabidopsis thaliana
  G1766,family:NAC
aggctattctcggaaaaacaaagaataaagaatgaattcgttttcacaagtacctcctggcttcagatttcatcctactgatgaagaacttgtagactactacttgaggaaaaaagttgcatcaaagagaatagaaatcgatatcatcaaggatgttgatctttacaagattgagccatgtgatcttcaagagttatgcaagataggaaacgaagagcagagcgaatggtacttctttagtcataaagacaagaagtatcccacgggaactcgaaccaatagagccacgaaagcaggattttggaaagccactggaagagacaaggctatatatataagacatagtcttatcggtatgaggaaaacacttgtgttttacaaaggaagagccccaaatggtcagaaatccgattggatcatgcacgaatatcgcttagaaacaagtgaaaatggaacccctcaggaagaaggatgggtagtatgtagggtattcaagaagaaattggcagcgacagtgaggaaaatgggagattaccattcatcaccatcgcagcattggtacgatgatcagctctcttttatggcctccgagatcatttctagttctccacgacagtttcttcccaatcatcattataaccgccaccatcaccagcagacattgccttgtggcctcaatgcattcaacaacaacaatcctaacttgcaatgcaagcaagagctcgagttacattacaatcaaatggtacaacatcaacaacaaaaccatcatcttcgtgaatctatgtttctccagcttcctcagctcgaaagccctaccagtaattgcaattctgacaacaacaataacacaagaaatattagtaacttgcagaaatcatcaaatatatctcatgaggaacaattgcaacaagggaatcaaagtttcagctctctgtattacgatcaaggagtagagcaaatgactactgactggagagttctcgataaatttgttgcttcacagcttagcaatgatgaagaggctgcagccgtggtttcttcttcttctcatcaaaacaacgtcaagattgacacgagaaacacgggttatcatgtgatagatgagggaataaatttgccggagaatgattctgaaagggttgttgaaatgggagaagagtattcaaatgctcatgctgcttctacttcttcaagttgtcagattgatctctagaaatagtgatagagagatgaaaaagatgcaaggtgaatatatatgaaaatacatgcacactagtgttatttatacttaaagatggaaggggaaaaacaaggagttatttcctggatttatggaggttttgtacataataaaaacctacaaccatatggtattttcttttgaaaaaaaaaaaaaaaaaaaaaaaa

SEQ ID NO: 1488 - protein, 394 aa, Arabidopsis thaliana
  G1766,NAC domain coordinates 10-153
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 1489 - DNA, 1634 bp, Arabidopsis thaliana
  G1768,family:SCR
cttccttttgcttcagctgcgagctttggttggatctctcacttgcaaaaccaaatcccttatcgacttccaccgaaagatcacttcttaacctacacaaggtgtttgttatgaagatcagataaataaaaggtcatttgaggataatggttgatgttcaaagattcttacttgcttatttgtgatggacaatgtaagaggttcaataatgttgcagccactgccagagatagctgagagtatcgatgatgctatctgccatgaactctccatgtggcctgatgatgctaaagatttgttattgatagtggaggcaatatcaaggggagacttgaagttggtacttgttgcttgtgcaaaagctgtttctgagaataatcttctaatggcacgatggtgtatgggtgagttgcgcggtatggtttcgatttctggtgagccaatccagagattgggagcttatatgttagaagggcttgttgctaggcttgctgcttctggtagttcgatatataagtctctccagtccagagaaccagagagttatgaatttttatcttatgtgtatgttctgcatgaggtttgtccatatttcaagtttggatacatgtcagcgaatggtgcgattgcagaagcaatgaaggatgaagagaggattcacattattgacttccaaattggacaagggagccagtggatagcacttatccaggcttttgcagctaggcctggtggggctccaaatattcgaattaccggagttggtgatggatctgtcttggttacagtcaagaagagactagagaaacttgcaaagaagtttgatgttccattcaggttcaatgcggtttcaaggccaagttgtgaagttgaagtggaaaatcttgatgtccgagatggcgaagcccttggagtgaactttgcttacatgctgcatcatttgccagatgagagtgtaagcatggaaaaccacagggaccggttgctgaggatggtgaagagtctatcacctaaagtagtcactcttgtggaacaagaatgcaacacgaacacttcccctttccttcctaggttccttgagacattaagttattacacggcaatgttcgaatctatcgatgttatgcttccgagaaatcacaaggaaaggatcaatatcgagcagcactgcatggcaagggatgtcgtcaacatcatagcttgtgaaggagccgagaggatcgaaagacacgagcttctcgggaaatggaagtcaaggttttccatggcgggttttgagccataccccttgagctcaatcatttcagccaccattagagccctcttgagagattacagcaacgggtatgcgattgaagaaagagatggtgctctgtaccttggttggatggaccgaatcttggtctcatcttgtgcatggaagtgaaagaataaacgtctccaagaatgtaatgcaaaagacagaactggaagtaatagatagttttgtctcataaccattaataaggttgaatcaaatcatatacatccccatgctacaactattacacaggctccatcaacaaagaagggctcttgttgtgttaccttctcttcctgtaactcttatttgaaccaaatggaagtggttacat

SEQ ID NO: 1490 - protein, 413 aa, Arabidopsis thaliana
  G1768,SCR domain coordinates 127-192,248-336,340-412
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 1491 - DNA, 1059 bp, Arabidopsis thaliana
  G1779,family:GATA/Zn
atgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtga

SEQ ID NO: 1492 - protein, 352 aa, Arabidopsis thaliana
  G1779,GATA/Zn domain coordinates 190-239
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 1493 - DNA, 549 bp, Arabidopsis thaliana
  G1791,family:AP2
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 1494 - protein, 139 aa, Arabidopsis thaliana
  G1791,AP2 domain coordinates 10-74
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 1495 - DNA, 696 bp, Arabidopsis thaliana
  G1792,family:AP2
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 1496 - protein, 139 aa, Arabidopsis thaliana
  G1792,AP2 domain coordinates 16-80
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 1497 - DNA, 450 bp, Arabidopsis thaliana
  G1795,family:AP2
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 1498 - protein, 131 aa, Arabidopsis thaliana
  G1795,AP2 domain coordinates 11-75
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 1499 - DNA, 833 bp, Arabidopsis thaliana
  G1798,family:MADS
atggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagatggagaagattatagatagatatggcaagtttagtaatgccttctatgtggcagagaggcctcaagtagaacgatacttgcaggagctgaagatggaaattgatagaatggtgaaaaagattgatctccttgaagttcatcaccgtaagctgttggggcaaggtttggattcgtgttcagtgacagaacttcaagagattgacactcaaattgagaaaagccttcgtattgtcaggtcaagaaaggctgagttatatgcagatcaactgaaaaagctaaaagaaaaggagagggagctcttgaacgagagaaaaaggctgcttgaagagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttccatacagtttatagttttctgagtgctcatgcatgaccatctcttcatatatatatgtgtataaactgaaaataatttgacatgtattatttgtcactttagtttttcttttgaatgaatgtgacattttgtt

SEQ ID NO: 1500 - protein, 219 aa, Arabidopsis thaliana
  G1798,MADS domain coordinates 1-57
MVRGKIEIKKIENVTSRQVTFSKRRSGLFKKAHELSVLCDAQVAAIVFSQSGRLHEYSSSQMEKIIDRYGKFSNAFYVAERPQVERYLQELKMEIDRMVKKIDLLEVHHRKLLGQGLDSCSVTELQEIDTQIEKSLRIVRSRKAELYADQLKKLKEKERELLNERKRLLEEQNRERLMRPVVPATLQICDKGNTEGGHRTKHSSEVETDLFIGLPVTRL

SEQ ID NO: 1501 - DNA, 318 bp, Arabidopsis thaliana
  G1816,family:MYB-related
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 1502 - protein, 105 aa, Arabidopsis thaliana
  G1816,MYB-related domain coordinates 30-74
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 1503 - DNA, 1308 bp, Arabidopsis thaliana
  G1817,family:PMR
atgaaggacgcagagaagcgagaggtgattgcatcatcatcattacaaagaaagagaaacagaggaagaagactaaggaaaagaagaagaagaaacgagaagcgagtactaatggttccatcatcattaccaaacgacgtgctagaggagatctttttaagatttccggttaaagccctaatccgactcaagtctctctcgaaacaatggagatcgacgatcgaatctcgcagttttgaagagagacacttgacgatcgctaagaaagccttcgtggatcatcccaaggtcatgctcgtaggagaagaagatcccataagaggaaccgggattcgtccagacactgacattggttttaggttattctgcttggaatcggcttctcttctatcctttactcgtctcaatttccctcaagggttcttcaactggatctacatatctgaaagctgtgatggccttttctgcatccattccccaaaatcacattccgtatatgtagtgaatccggctacacggtggctccgcctacttcctccggcagggtttcagattttgatccacaagtttaaccccactgaacgtgagtggaatgtagtgatgaaatcaatctttcatctagcattcgtgaaggccaccgattacaaattagtgtggttgtacaattgtgataagtacattgttgatgcgtcgagtccaaacgtgggagtcacaaagtgcgagatttttgactttaggaaaaatgcttggaggtacttggcttgcactccaagtcatcagatattctattaccaaaagccagcatctgcaaacgggtcggtttattggtttacagaaccatataatgaaagaatcgaagtagtggcttttgatattcagaccgaaacattccggttgctgcctaagattaatccggctattgctggttcagatcctcaccatattgacatgtgcactctggataatagtttgtgtatgtcgaaaagggagaaagatactatgatccaagatatttggaggttgaaaccatcagaagacacatgggaaaagatttttagcatagacttggtttcctgtccttcttctcggactgagaagcgtgatcaatttgattggagcaagaaggatagggttgagccagccacacccgtcgcggtttgtaagaataagaagatccttctctcacatcgctattcccgaggtttggtaaagtacgatcccctaacaaaatctatcgattttttttccggacatcctaccgcttacagaaaagttatttattttcaaagtttgatatctcatctataa

SEQ ID NO: 1504 - protein, 435 aa, Arabidopsis thaliana
  G1817,PMR domain coordinates 47-331
MKDAEKREVIASSSLQRKRNRGRRLRKRRRRNEKRVLMVPSSLPNDVLEEIFLRFPVKALIRLKSLSKQWRSTIESRSFEERHLTIAKKAFVDHPKVMLVGEEDPIRGTGIRPDTDIGFRLFCLESASLLSFTRLNFPQGFFNWIYISESCDGLFCIHSPKSHSVYVVNPATRWLRLLPPAGFQILIHKFNPTEREWNVVMKSIFHLAFVKATDYKLVWLYNCDKYIVDASSPNVGVTKCEIFDFRKNAWRYLACTPSHQIFYYQKPASANGSVYWFTEPYNERIEVVAFDIQTETFRLLPKINPAIAGSDPHHIDMCTLDNSLCMSKREKDTMIQDIWRLKPSEDTWEKIFSIDLVSCPSSRTEKRDQFDWSKKDRVEPATPVAVCKNKKILLSHRYSRGLVKYDPLTKSIDFFSGHPTAYRKVIYFQSLISHL

SEQ ID NO: 1505 - DNA, 1740 bp, Arabidopsis thaliana
  G1818,family:CAAT
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 1506 - protein, 186 aa, Arabidopsis thaliana
  G1818,CAAT domain coordinates 24-116
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 1507 - DNA, 837 bp, Arabidopsis thaliana
  G1832,family:Z-C2H2
agtaagagactcaataataatgtcgaacacttcaaactccgatcccaattccgatatcccatttgcttcctccaatgtaactcttcctagttacaatcaaaacccaagaagaaaacgtactaaactcaccaacaacgaagtcggttcttcttcgtcttctccaaggcctaaaccggtcacgcaaccggaccctgatgcttcacaaatcgcacgaccatgtactgaatgtggtaaacaattcgggtcactgaaggcactctttggacacatgagatgtcaccctgaacgtcagtggcgtggcatcaaccctccttctaacttcaaacgtaggatcaactcaaacgctgcgtcatcatcctcgagttgggatccatctgaggaagagcataacatagcctcctgtttactaatgatggctaatggtgatgtcccaacccgttcaagtgaagttgaggaacggtttgagtgtgatggttgtaagaaagtgtttgggtcacatcaagcgttaggcggacatagagcaacacataaagacgtcaaaggatgtttcgccaataaaaacataaccgaagatcctcctcctccacctcctcaagagatcgttgatcaagataagggcaagagtgtgaagttggtctcggggatgaatcatcgatgtaacatctgttctagagtgttctccagtggtcaagcgttaggaggtcacatgagatgtcattgggagaaagatcaggaagagaaccaagtcaggggcattgatcttaatgttcctgcggcgacatcttcagacacaacgttaggttgttccttggatcttaggttaggactttgatatat

SEQ ID NO: 1508 - protein, 270 aa, Arabidopsis thaliana
  G1832,Z-C2H2 domain coordinates 67-87,150-166,213-233
MSNTSNSDPNSDIPFASSNVTLPSYNQNPRRKRTKLTNNEVGSSSSSPRPKPVTQPDPDASQIARPCTECGKQFGSLKALFGHMRCHPERQWRGINPPSNFKRRINSNAASSSSSWDPSEEEHNIASCLLMMANGDVPTRSSEVEERFECDGCKKVFGSHQALGGHRATHKDVKGCFANKNITEDPPPPPPQEIVDQDKGKSVKLVSGMNHRCNICSRVFSSGQALGGHMRCHWEKDQEENQVRGIDLNVPAATSSDTTLGCSLDLRLGL

SEQ ID NO: 1509 - DNA, 683 bp, Arabidopsis thaliana
  G1840,family:AP2
acttttgatccttcgcattcactaaataagtacatattatcagtttgacaccaaaaaaatggattattcagaaaatgttcaaaacaaaaatttcacccctatttcacaacctcctaacttgacaagagaccaagaacatgctatcatggtttctactttgcgacaagtgatatccaacactggaggtgatacgtcatcatctcactacattgctgcaagtgaggctcttccaccttcggacgctggcccttgtcctctttgcggcgtcaccagttgctacgggtgcgcattcccacagcatgaagagattaagcaggagaagaagcataaaggagtgaggaagaagccatcaggaaaatggtcggcggaaatatgggatccgagtacaagaacaaggaggtggcttggaacgtttccgacggcagagatggcagcggatgcttacgatgaggcagcggctgcgcttgtcgaaaaaagatcagcgagacgtggctcaaagaagggagaaggaagcattcaccaagaagtcggcggcggagatgactgagaaattaagctatataactatatatcgttttatagggggaaaaatagatgttttgggagaaattaatacattacctagatgggttatatgttttacgagaaaccacttgcgtgtgttttttttttaataagaggtt

SEQ ID NO: 1510 - protein, 162 aa, Arabidopsis thaliana
  G1840,AP2 domain coordinates 87-154
MDYSENVQNKNFTPISQPPNLTRDQEHAIMVSTLRQVISNTGGDTSSSHYIAASEALPPSDAGPCPLCGVTSCYGCAFPQHEEIKQEKKHKGVRKKPSGKWSAEIWDPSTRTRRWLGTFPTAEMAADAYDEAAAALVEKRSARRGSKKGEGSIHQEVGGGDD

SEQ ID NO: 1511 - DNA, 1160 bp, Arabidopsis thaliana
  G1846,family:AP2
aatttcataaatcatagagagagagagagagagagagagagagtttggaaacattccaaaaccagaactcgatattatttcaccaaagaatgatagaaacaagaactatctttttataaaactctttacaccccaaaagaaaatgtctcactcgttttgccttataatatttctttcaacaacaacccaaatctacaaaaaatcccaataaaaaaaaacttcagtctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatac

SEQ ID NO: 1512 - protein, 221 aa, Arabidopsis thaliana
  G1846,AP2 domain coordinates 16-83
MADSSSDKEKKENNKQPVYRGVRMRSWGKWVSEIREPRKKSRIWLGTFPTAEMAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 1513 - DNA, 1774 bp, Arabidopsis thaliana
  G1868,family:GRF-like
tcccatggcaactatctctcaagtcattatctaactttttttccttctttttctttttatattacttacttcttatggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacaaatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctgaaaactgaaaccaagtcctgcggcaggaaacaaaaaaagaaaagctctgttttttctctttcattatgttctgtttcgtctttctaaagctgc

SEQ ID NO: 1514 - protein, 535 aa, Arabidopsis thaliana
  G1868,GRF-like domain coordinates 164-270
MDIGVHVLGSVTSNENESLGLKELIGTKQDRSGFIGEDCLQRSLKLARTTTRAEEEENLSSSVAAAYCKTMSFHQGIPLMRSASPLSSDSRRQEQMLSFSDKPDALDFSKYVGLDNSSNNKNSLSPFLHQIPPPSYFRSSGGYGSGGMMMNMSMQGNFTGVKGPFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVEVQSGQNQTAAAASKAVTTPQQPVVAGNTNRSNARASSNRSLAIGSQYINPSTESLPNNRGVSIYPSTVNLQPKESPVIHQKHRNNNNPFEFGHKSSDSLLNPNTAKTYGSSFLDFSSNQEKHSGNHNHNSWPEELTSDWTQLSMSIPIASSSPSSTHNNNNAQEKTTLSPLRLSRELDLSIQTDETTIEPTVKKVNTWIPISWGNSLGGPLGEVLNSTTNSPTFGSSPTGVLQKSTFCSLSNNSSVSSPIAENNRHNGDYFHYTT

SEQ ID NO: 1515 - DNA, 1107 bp, Arabidopsis thaliana
  G1879,family:HLH/MYC
aaatgcccttagaggctgtcgtatacccgcaagatccattcggatatctctccaattgcaaagattttatgttccacgacttatactctcaagaagagttcgtagctcaagatacgaagaacaacattgataagttagggcatgaacagagctttgtggaacaaggtaaggaggacgatcatcaatggcgagactatcatcagtatcctttgttgatcccttcgttgggagaagagcttggtcttaccgccattgatgtggagagtcatcctcctccacagcaccggaggaagaggaggagaacgagaaactgcaagaacaaggaagagatcgagaaccagagaatgactcacatcgccgtcgagagaaatcgccggaaacagatgaacgagtatctggctgtgctccgttctctaatgccgtcgtcgtatgctcaaagaggagatcaagcgtcgatagtaggaggagctataaactacgtgaaggagttagagcatattttacaatctatggagccgaagagaactaggactcatgatcccaaaggagacaagactagcactagctcgttagtgggtccattcacagattttttcagcttcccacaatattctacaaagtcatcatcagatgtaccggaaagctcatcttcaccggcggagatagaggttacggtggcagaaagccatgcgaacatcaagataatgacgaagaagaaaccgaggcagcttcttaagctcataacttctttacaaagcctaaggctcactcttcttcatctcaatgtcaccactctccacaactccattctctactccatcagcgtcagggttgaagaaggaagccaactgaataccgtggacgacattgcaacagctttgaatcaaaccataaggaggattcaagaagagacataattcagcaaatagattataattaacttgttttatttttattttattttgaaataactgaaatcagttttctaattttttttttttttcactattcctctaatcctccctatgtaagttgcatttttgtctcttgtaatgaatcaatggtcataaagatctgaacaaaaaaattgaataaaagaaaatggtt

SEQ ID NO: 1516 - protein, 304 aa, Arabidopsis thaliana
  G1879,HLH/MYC domain coordinates 109-168
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 1517 - DNA, 1182 bp, Arabidopsis thaliana
  G1887,family:Z-LSDlike
atgttgttgctggtggactgctccagctgtcgtacgccgcttcaccttcctcccggagccacccgaatccgctgcgccatttgtcacgccttcactctcatcgcccccgagccccgtctccaatctcacgcgtcggcgagcccttttcctttccccaactcatctccggctccatccactttcatctacccgccgccaacaccttctccgtacactcacgcgccgcatgcaccgtctccattcaaccacgcgcctccagattcttacccgttcactcacgcgcctccagcatcgtctccattcaaccacgcgccgccgggtcctccaccgccggtacatggacagaagcgagcggtgatagtcggggtttcttacaagaacacaaaggacgaactcaaaggatgtatcaatgacgcaaactgcatgaagttcatgttgatgaagcgtttccaattccctgaatcttgcattcttatgctcaccgaagaagaagcggacccaatgagatggccaacgaagaacaacataacaatggcgatgcattggcttgttcttagctgcaaaccgggagattccctcgtctttcacttctccggtcacggcaacaaccagatggacgacaacggcgacgaggttgacggcttcgatgagactcttctcccggtggaccacaggacttcaggtgtcatcgtggacgatgagatcaatgctacaatcgtacggccgctcccttatggagttaagctccatgccatcgtcgacgcttgtcatagtggtaccgtcatggacttaccttatctttgtagaatggacaggctcggaaactatgaatgggaagaccatcggcctaaaacaggaatgtggaaaggtacgagtggcggtgaagtcttctccttcacaggctgcgatgatgaccagacctcggctgacactccggccatagaacgtggccacgggatgacttatgggagcttgctgaatgcaatgagatcaacggttcatgagatcttcgacaaaaacaaaggtagagagcttgtggaagtgggaggtgctgattttctctctactcttcttggtttgctcatcttaggcgcttctcctcctgatgaggaagaggaagtaaaccaagcccctcaaaaaactcaggtgatccattcatctatactaattatttttatctaa

SEQ ID NO: 1518 - protein, 393 aa, Arabidopsis thaliana
  G1887,Z-LSDlike domain coordinates 4-34
MLLLVDCSSCRTPLHLPPGATRIRCAICHAFTLIAPEPRLQSHASASPFPFPNSSPAPSTFIYPPPTPSPYTHAPHAPSPFNHAPPDSYPFTHAPPASSPFNHAPPGPPPPVHGQKRAVIVGVSYKNTKDELKGCINDANCMKFMLMKRFQFPESCILMLTEEEADPMRWPTKNNITMAMHWLVLSCKPGDSLVFHFSGHGNNQMDDNGDEVDGFDETLLPVDHRTSGVIVDDEINATIVRPLPYGVKLHAIVDACHSGTVMDLPYLCRMDRLGNYEWEDHRPKTGMWKGTSGGEVFSFTGCDDDQTSADTPAIERGHGMTYGSLLNAMRSTVHEIFDKNKGRELVEVGGADFLSTLLGLLILGASPPDEEEEVNQAPQKTQVIHSSILIIFI

SEQ ID NO: 1519 - DNA, 625 bp, Arabidopsis thaliana
  G1889,family:Z-C2H2
acacgatcaaaactcattattcaacaaagtcttcgtttcatttttcatttttcatttctcaaccaaaaaaaaaaagagtgattttttttttaatcatcagtcaaatggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttctgatttttgttcgtttttctttttagggtatacttgtgtagggtaagtttatt

SEQ ID NO: 1520 - protein, 156 aa, Arabidopsis thaliana
  G1889,Z-C2H2 domain coordinates 80-100
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 1521 - DNA, 750 bp, Arabidopsis thaliana
  G1891,family:Z-Dof
atggataacttgaatgttttcgcaaatgaagacaatcaagtgaatgatgtgaagcccccaccaccaccacctcgagtgtgtgcaaggtgtgattctgataatactaaattttgttattacaacaactactgtgagtttcagccacgatacttctgcaagaactgtcgtagatactggactcatggtggggctttaagaaacataccaattggtggaagtagtcgtgccaaacgggcaagggtaaatcaaccttcggttgctcggatggtttctgttgagacccaacgaggtaacaatcaacctttctctaatgttcaagaaaacgttcatcttgttggatcttttggtgcttcatcttcatcttctgttggtgctgttgggaacctttttggttctttgtatgatattcatggtggtatggtaacaaatttgcatccaactcgaactgttcgaccaaatcatcgcttagctttccatgatggatcatttgagcaagactattacgatgttgggtccgataatcttttggtcaaccaacaagttggtggctacggttatcacatgaatccagtggatcaattcaagtggaaccagagcttcaacaacactatgaacatgaattataataacgatagcactagtggaagtagcagaggatctgacatgaatgtgaaccatgataacaagaagatcagataccgcaactctgtgattatgcatccttgtcatctggagaaggatggtccttga

SEQ ID NO: 1522 - protein, 249 aa, Arabidopsis thaliana
  G1891,Z-Dof domain coordinates 27-69
MDNLNVFANEDNQVNDVKPPPPPPRVCARCDSDNTKFCYYNNYCEFQPRYFCKNCRRYWTHGGALRNIPIGGSSRAKRARVNQPSVARMVSVETQRGNNQPFSNVQENVHLVGSFGASSSSSVGAVGNLFGSLYDIHGGMVTNLHPTRTVRPNHRLAFHDGSFEQDYYDVGSDNLLVNQQVGGYGYHMNPVDQFKWNQSFNNTMNMNYNNDSTSGSSRGSDMNVNHDNKKIRYRNSVIMHPCHLEKDGP

SEQ ID NO: 1523 - DNA, 1503 bp, Arabidopsis thaliana
  G1895,family:Z-Dof
cgtcgaccacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcatgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattctgtagtactagtgtc

SEQ ID NO: 1524 - protein, 317 aa, Arabidopsis thaliana
  G1895,Z-Dof domain coordinates 58-100
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 1525 - DNA, 897 bp, Arabidopsis thaliana
  G1900,family:Z-Dof
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 1526 - protein, 298 aa, Arabidopsis thaliana
  G1900,Z-Dof domain coordinates 54-106
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 1527 - DNA, 615 bp, Arabidopsis thaliana
  G1902,family:Z-Dof
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 1528 - protein, 204 aa, Arabidopsis thaliana
  G1902,Z-Dof domain coordinates 31-59
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 1529 - DNA, 294 bp, Arabidopsis thaliana
  G1911,family:MYB-related
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 1530 - protein, 97 aa, Arabidopsis thaliana
  G1911,MYB-related domain coordinates 12-62
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 1531 - DNA, 1695 bp, Arabidopsis thaliana
  G1927,family:NAC
atggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtga

SEQ ID NO: 1532 - protein, 564 aa, Arabidopsis thaliana
  G1927,NAC domain coordinates 17-188
MVDSSRDSCFKAGKFSAPGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVDSDSEDADSVAVPDYPVVRYENGPCVDDTKFCNPVKLQLEDIEKLLNEIPDAPGVNQRQFDEFVGVPQGNSAEVIQSTLLNNSSGEYIDPRTNGMFLPNGQLYNRDSSFQSHLNSFEATSGMAPLLDNEKEEYIEMNDLLIPELGASSTEKSTEFLNHGEFGDVNEYDQLFNDISVFQGTSTDLSCLSNFTNNTSGQRQQLLYEQFQYQTPENQLNNYMHPSTTLNQFTDNMWFKDDQAALYVQPPQSSSGAFTSQSTGVMPESMNPTMSVNPQYKEGQNGGGTRSQFSSALWELLESIPSTPASACEGPLNQTFVRMSSFSRIRFNGTSVTSRKVTVAKKRISNRGFLLLSIMGALCAIFWVFKATVGVMGRPLLS

SEQ ID NO: 1533 - DNA, 366 bp, Arabidopsis thaliana
  G1929,family:Z-CO-like
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 1534 - protein, 121 aa, Arabidopsis thaliana
  G1929,Z-CO-like domain coordinates 31-53
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 1535 - DNA, 1155 bp, Arabidopsis thaliana
  G1930,family:AP2
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 1536 - protein, 333 aa, Arabidopsis thaliana
  G1930,AP2 domain coordinates 59-124,179-273
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 1537 - DNA, 1554 bp, Arabidopsis thaliana
  G1942,family:HLH/MYC
cactccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggctaatggatctgacccaaggtttcagagctagatccggcgttgttgggccggtggccggactagaatctctcaatttcagcgacgaatttcggcacttagtgacgacgatgcctccggagactactggcggctccttcacggctttactcgagatgcctgtgactcaggccatggagcttctccatttcccagattcatcgtcttctcaggccagaaccgttaccagtggtgatatttctcctaccactcttcaccctttcggggctttgacttttccttctaactcgcttctcttggaccgcgccgctcgtttctcggtgattgctacagagcaaaacggtaatttttccggcgagactgctaactctttaccttctaatcccggcgcgaatctggacagagtcaaagccgagcctgctgagaccgattcaatggtggagaatcagaaccagagctactcttctggaaaaaggaaagaacgcgagaagaaggtcaaaagctcgacgaagaagaacaagagctccgtggagtcagacaagttgccatatgttcatgtcagagctcgtcgtggtcaagctactgataaccatagcttagcagagagagcaagaagggagaagataaacgcacgaatgaagctgctacaggaactggtcccaggctgtgataagattcagggcactgcattggttctggatgaaatcattaaccatgtgcaaactttacagcgtcaagtggagatgctatctatgagacttgctgcagtaaaccccagaatcgacttcaatctagacagcatactggcttcagagaacggctctcttatggatggtagcttcaatgcagagtcttatcatcagctgcaacaatggcctttcgacggctaccaccagccggaatggggaagagaagaagatcatcatcaagccaatttctcaatgggttcagctactttacacccaaatcaggtgaaaatggagctctaagttggaaacagtttgacatgcttatgtgtatatataagagttatatatatctactaaagtttcgattgttgaattagaggtagaaaatggttatgattgtttcaggtctttgttcatggcctttctatatttactagattcctcaatgtagaattcagaatgtctaaattgcgtttcccttgagagaagtatatgaagatttgatatgttactgaacaaaaaaaaaaaa

SEQ ID NO: 1538 - protein, 327 aa, Arabidopsis thaliana
  G1942,HLH/MYC domain coordinates 188-246
MDLTQGFRARSGVVGPVAGLESLNFSDEFRHLVTTMPPETTGGSFTALLEMPVTQAMELLHFPDSSSSQARTVTSGDISPTTLHPFGALTFPSNSLLLDRAARFSVIATEQNGNFSGETANSLPSNPGANLDRVKAEPAETDSMVENQNQSYSSGKRKEREKKVKSSTKKNKSSVESDKLPYVHVRARRGQATDNHSLAERARREKINARMKLLQELVPGCDKIQGTALVLDEIINHVQTLQRQVEMLSMRLAAVNPRIDFNLDSILASENGSLMDGSFNAESYHQLQQWPFDGYHQPEWGREEDHHQANFSMGSATLHPNQVKMEL

SEQ ID NO: 1539 - DNA, 825 bp, Arabidopsis thaliana
  G197,family:MYB-(R1)R2R3
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 1540 - protein, 274 aa, Arabidopsis thaliana
  G197,MYB-(R1)R2R3 domain coordinates 14-116
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 1541 - DNA, 513 bp, Arabidopsis thaliana
  G1974,family:Z-C2H2
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtactga

SEQ ID NO: 1542 - protein, 170 aa, Arabidopsis thaliana
  G1974,Z-C2H2 domain coordinates 32-60,72-116
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 1543 - DNA, 1014 bp, Arabidopsis thaliana
  G1986,family:Z-C2H2
atgaattcttatgagacgaaaggcttaagtttcgaatccccaagctttattgaatggcttaaacctcaatcttctactacttcttctaaatctgtgttatatcgtgggaagacaagagatgctatatcaagatcaaatcaccaccagagtcagatgaacatgttggaacgatctctattcttgtaccaaccacaagaaccactcaacacgtctattcaatgcttgcctcttctaaacaagctcatggaaaataatagtcaagcctcggatatcaaagaagagaataaggatgatgtggttaccctccaaatcggatttcctaaataccaccgtggtagctcggaggatggctctgatataactttcgatcatcagaagaaacccatcaagagagagataatagaagatggtgtggtgatgatgaagaagaggaggaagatgaagtttgatgaggagataattgattctgatgtggaagtatgtgggaagaggttttggataccaagtccggctcagattcatgtcggtccaatgcaatttgcttgctctatttgcagcaaaacattcaataggtacaataacatgcagatgcatatgtggggacatggatctgagttcagaaaaggggctgactcgttgaaaggcacaatccaaccggcagccatcctgcggctgccatgctattgctgtgccgagggatgcaagaacaacatcaaccatccgcggtccaagcccctgaaagatttccgtacacttcagacacattacaaacgtaagcatggctccaagcccttttcttgcggaaaatgtggcaaagccttggctgtgaaaggcgactggaggacccatgagaaaaactgcggaaagctttggtattgtacatgtggatcagatttcaagcataagaggtctctcaaggaccacattaggtcctttggcagtggacattctcctcacccgtctcttttgtttgacggttttgaggaggatacagaatgcgtcaccacagagtga

SEQ ID NO: 1544 - protein, 337 aa, Arabidopsis thaliana
  G1986,Z-C2H2 domain coordinates 182-202,267-287
MNSYETKGLSFESPSFIEWLKPQSSTTSSKSVLYRGKTRDAISRSNHHQSQMNMLERSLFLYQPQEPLNTSIQCLPLLNKLMENNSQASDIKEENKDDVVTLQIGFPKYHRGSSEDGSDITFDHQKKPIKREIIEDGVVMMKKRRKMKFDEEIIDSDVEVCGKRFWIPSPAQIHVGPMQFACSICSKTFNRYNNMQMHMWGHGSEFRKGADSLKGTIQPAAILRLPCYCCAEGCKNNINHPRSKPLKDFRTLQTHYKRKHGSKPFSCGKCGKALAVKGDWRTHEKNCGKLWYCTCGSDFKHKRSLKDHIRSFGSGHSPHPSLLFDGFEEDTECVTTE

SEQ ID NO: 1545 - DNA, 762 bp, Arabidopsis thaliana
  G1995,family:Z-C2H2
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 1546 - protein, 253 aa, Arabidopsis thaliana
  G1995,Z-C2H2 domain coordinates 93-113
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 1547 - DNA, 1320 bp, Arabidopsis thaliana
  G2003,family:Z-C2H2
atggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcagattggaaagctcactctaagacttgtggtactaaagagtatcgatgtgactgtggtaccatcttctctagacgtgatagttacatcacgcatagggctttctgcgatgcattgatacaagagactgcaagaaaccctaccgtgagctttacgtcaatgacagctgctagtagtggtgtcggctccggcggaatctacgggagacttggcggtggcagtgctctctcacaccaccatttgagtgaccatccaaattttggatttaaccctctcgtgggttacaatctgaacattgcatcttctgataataggagagactttattccgcaatcatcaaaccctaacttcctaatccaaagcgcttcgagccaaggaatgttgaatacaacgccaaacaacaataaccagagtttcatgaaccagcatggtctgatacagtttgatccagtcgacaacatcaacctcaagagtagcggcaccaacaacagcttcttcaacctcggattctttcaagaaaacacgaagaactcagagacgagtcttccttctctatatagcaccgacgttcttgttcatcaccgtgaagaaaacttgaacgcgggttctaacgtgtcagccacggcactacttcagaaagctacacaaatgggttcagtcacaagcaacgacccatctgctttgttcagaggcttagcttcttcgtctaactcatcaagtgttatcgctaatcactttggtggaggacgaattatggagaatgataataatggaaaccttcaaggtctaatgaactcattagccgccgttaatggaggtggcggatccggtggcagtatcttcgacgttcaatttggagacaatggaaatatgagcggctcggacaagttaacgttagattttcttggagttggaggaatggtgagaaatgtaaatcgcggtggtggtggtggtggtcgcggcagtgctcgtggcggagtttctttggatggtgaggcgaagtttcctgagcaaaattatccatttggaagaggttga

SEQ ID NO: 1548 - protein, 439 aa, Arabidopsis thaliana
  G2003,Z-C2H2 domain coordinates NA
MATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRRDSYITHRAFCDALIQETARNPTVSFTSMTAASSGVGSGGIYGRLGGGSALSHHHLSDHPNFGFNPLVGYNLNIASSDNRRDFIPQSSNPNFLIQSASSQGMLNTTPNNNNQSFMNQHGLIQFDPVDNINLKSSGTNNSFFNLGFFQENTKNSETSLPSLYSTDVLVHHREENLNAGSNVSATALLQKATQMGSVTSNDPSALFRGLASSSNSSSVIANHFGGGRIMENDNNGNLQGLMNSLAAVNGGGGSGGSIFDVQFGDNGNMSGSDKLTLDFLGVGGMVRNVNRGGGGGGRGSARGGVSLDGEAKFPEQNYPFGRG

SEQ ID NO: 1549 - DNA, 1292 bp, Arabidopsis thaliana
  G201,family:MYB-(R1)R2R3
atgtcaagaaagccatgttgtgtgggagaaggactgaagaaaggagcatggactgccgaagaagacaagaaactcatctcttacattcatgaacacggtggaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacaatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattatgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaaaaaaaaaaaaaaaaaaaaaaa

SEQ ID NO: 1550 - protein, 336 aa, Arabidopsis thaliana
  G201,MYB-(R1)R2R3 domain coordinates 14-114
MSRKPCCVGEGLKKGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYNFSQFLEQFSNNEGEEADNTGGGYNQDLLMSDVSSTSVDEDEMMQNITGWSNYLLDHSDFNYDTSQDYDDKNFI

SEQ ID NO: 1551 - DNA, 2034 bp, Arabidopsis thaliana
  G2016,family:AKR
atggttgacttttttgtttgtggacgtggtagtaactattctggagcagatctagatagaattgaggcacaaagcggaggagttggcaccacgtcacctacgggcgacaccgaacctgtgccaaagttccgtactaaccttaaattgtcggatcttttcgctctccctggtgaagatgtcgagatgactccggagatttttggtggaatgagtaatggggaaaaagaatgtctggagaagttgagaagcaatggaacgccaatggaacgtgtcaagagcaatacaggagattcaattcttcatattgctgctaaatggggtcatctggaactagtgaaggagattatctttgaatgtccatgccttctattcgagcaaaactcaagccgtcagacaccgctacatgtggctactcatggcggtcataccaaagttgttgaggctcttgttgcatcggtaacatctgctttagctagtctgagtactgaagagagtgagggactgaatccacatgttcttaaggacgaagatggaaatactgctctgtactacgccattgaaggacgctatttggagatggctacctgtctggtgaacgcggacaaggatgctccttttcttggaaataacaagggaatatcttccttgtacgaagccgtagacgctggaaataaatttgaagaccttgtgaaagcaattttgaaaaccacagacgacaacgtggaccgtgaagtgaggaagtttaacttagattcgaaattacaagggaacaaacatcttgcacatgttgctttgaaggccaaaagtataggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctgtggataccagtttactaatctctcgaatttatgaaccacattcaaaggagatgagtttaacaaaaaaaaaagggggaaaggttgtgtcttttgatgataatttgacgaaccctaatgtatctgaaagctgttaa

SEQ ID NO: 1552 - protein, 677 aa, Arabidopsis thaliana
  G2016,AKR domain coordinates 100-428
MVDFFVCGRGSNYSGADLDRIEAQSGGVGTTSPTGDTEPVPKFRTNLKLSDLFALPGEDVEMTPEIFGGMSNGEKECLEKLRSNGTPMERVKSNTGDSILHIAAKWGHLELVKEIIFECPCLLFEQNSSRQTPLHVATHGGHTKVVEALVASVTSALASLSTEESEGLNPHVLKDEDGNTALYYAIEGRYLEMATCLVNADKDAPFLGNNKGISSLYEAVDAGNKFEDLVKAILKTTDDNVDREVRKFNLDSKLQGNKHLAHVALKAKSIGVLDVILDEYPSLMDEQDEDGRTCLSYGASIGYYKGLCNILNRSTKGVYVCDQDGSFPIHSAAKNEHYEIIKEFIKRCPASKYLLNRLGQNILHVAAKNEASLTAYMLMHDKDTKHLGVGQDVDGNTPLHLAVMNWDFDSITCLASRNHEILKLRNKSGLRARDIAESEVKPNYIFHERWTLALLLYAIHSSGFESVKSLTIQSVPLDPKKNRHYVNALLVVAALVATVTFAAGFTIPGGYISDSKKPNLGRATLATNPTLFIFLLFDILAMQSSVATICTLIWAQLGDLALILKSLHVALPLLLFSLLCMPVAFLFGVITAIAHVKWLLVTISIISGGFFLFAIFILGPHVMLQRSHLPPSSVDTSLLISRIYEPHSKEMSLTKKKGGKVVSFDDNLTNPNVSESC

SEQ ID NO: 1553 - DNA, 1854 bp, Arabidopsis thaliana
  G2017,family:AKR
gaacttaaatatgtgttttcaaacgatttttgtgtgatgattttaggattgtgatggacagttctgaagcacatctagatagaattgaggcacagaggtcaacggatgtgtctcatgaccaacagaaaaaaagatacttcccaatgaatctgataaacaaagtcgcaagcaaactctgttcacgaggaggagatggcgccacgccacctatgggagacaatgaatctgggctagagttcctcaacaacctcaaattatcggatcttttccatctcccgggtgaaaatgtccagatgaatacggaagtttttagcggactgagtgatggggacaaagagtgtctggagatgttgaaaggcgttggaacgccaatggcatgtctcaagagcgatagaggagattcagttcttcatcttgctgctagatggggtcatctagaactagtgaagaacattatctctgaatgcccatgccttgtattggagttaaacttcaaggatcagcttccgcttcatgtggcagctcatgccggtcattcggctattgttgaggctcttgttgcgtcggtaacatttttttcagatagactggctgaagaagatagagagagactaaatccatatgttctcagagacaaatatggaaatactgctctgcacttggccattgaaggacgctatatggagatggctgcctctctggtgaacgagaaccagaatgcttcttttcttgaaaataatgagggaatatcttccttgtacatggcagtagaagctggagatgtgactcttgtgaaagaaattttgaaaaccgcaggtaacaatgaccttgaagggaggaactctaacttagattcaaagttggaagggagaaaacatcttgtacatgttgctttgaatgccagaagtataggtgtccttgatgttattcttaacgaatatccaagtcttgaggacgagcgagatgaagaaggaaggacttgtctatcctttgcagcatccatagggttttataaaggagtatgcaacctgttagaccgatcaacaaagaatgtttatgtctgtgacgaagatggttcttttccaatacatacggctgcagagaacggccatatcagaattgtcaaagagattctaaaacgttgtccacattcaaaacacatgctcaacaaacttggccagaacgttctccacattgcagcaaagattggggaacataatcttgtaaaatcgttgatgcgaagtgatgatacaaaacatttgggtgttggtcaagatgtggatggtaatacacctttgcaccttgctgtcctaaattggcgctaccgatcaattagaacgctagcttcggatgtaaagatactgcaactacgaaacgataacggcttaacagctaggggtattgccgagtcagtgctgaaacccaactacatctttcatgagaggttgacactggcattcttattagacgctcacgcgtttaggggttgtggatctgttaagtcgttaacaaaaccatcagaaccactagaccatgaaaagagcagagattacgtcaacactcttctactggtagcagcacttgtagccacaatgacgtttgctgcaggttttacaataccaggtggctttaatagctctgctccacacttaggaagagcaactttgaccactgacccaaatctcttcttttttctgctatttgacatattggcaatgcaaacatcagttgcatcaatatgtactcttatatatatgggcgcagttgggtgatccatcactcgtttcatcatccttaaatgtggccttgcccttactgcttttttctctactctgcatgccattggcattcctt

SEQ ID NO: 1554 - protein, 572 aa, Arabidopsis thaliana
  G2017,AKR domain coordinates 114-439
MDSSEAHLDRIEAQRSTDVSHDQQKKRYFPMNLINKVASKLCSRGGDGATPPMGDNESGLEFLNNLKLSDLFHLPGENVQMNTEVFSGLSDGDKECLEMLKGVGTPMACLKSDRGDSVLHLAARWGHLELVKNIISECPCLVLELNFKDQLPLHVAAHAGHSAIVEALVASVTFFSDRLAEEDRERLNPYVLRDKYGNTALHLAIEGRYMEMAASLVNENQNASFLENNEGISSLYMAVEAGDVTLVKEILKTAGNNDLEGRNSNLDSKLEGRKHLVHVALNARSIGVLDVILNEYPSLEDERDEEGRTCLSFAASIGFYKGVCNLLDRSTKNVYVCDEDGSFPIHTAAENGHIRIVKEILKRCPHSKHMLNKLGQNVLHIAAKIGEHNLVKSLMRSDDTKHLGVGQDVDGNTPLHLAVLNWRYRSIRTLASDVKILQLRNDNGLTARGIAESVLKPNYIFHERLTLAFLLDAHAFRGCGSVKSLTKPSEPLDHEKSRDYVNTLLLVAALVATMTFAAGFTIPGGFNSSAPHLGRATLTTDPNLFFFLLFDILAMQTSVASICTLIYMGAVG

SEQ ID NO: 1555 - DNA, 1101 bp, Arabidopsis thaliana
  G202,family:MYB-(R1)R2R3
atgtcaagaaagccatgttgcgtcggagaaggcttgaagaaaggagcatggaccaccgaggaggacaagaaactcatctcttacatccacgaccacggcgagggaggctggcgcgacattccccaaaaagctgggttgaaacggtgtggaaagagttgtagactgcgatggaccaactaccttaaacctgagatcaaaagaggcgagtttagttcagaggaagagcagattatcatcatgcttcatgcttctcgtggcaacaagtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 1556 - protein, 366 aa, Arabidopsis thaliana
  G202,MYB-(R1)R2R3 domain coordinates 13-116
MSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLMEQGIDPVTHKPLASSSNPTVDENLNSPNASSSDKQYSRSSSMPFLSRPPPSSCNMVSKVSELSSNDGTPIQGSSLSCKKRFKKSSSTSRLLNKVAAKATSIKDILSASMEGSLSATTISHASFFNGFTEQIRNEEDSSNTSLTNTLAEFDPFSPSSLYPEHEINATSDLNMDQDYDFSQFFEKFGGDNHNEENSMNDLLMSDVSQEVSSTSVDDQDNMVGNFEGWSNYLLDHTNFMYDTDSDSLEKHFI

SEQ ID NO: 1557 - DNA, 1937 bp, Arabidopsis thaliana
  G2022,family:AKR
aggcgccaaattatcaatatgggaaggtctgatctggattttgaccgtcagaagaaagacgcaagctctaggatgttttatgcagacgaaaccgggcgtacgcactctctcgatttgtcaactctcttcaatgacacaagtgaaactgtgccaatgggtccaaagaccatcgccgctgtaagagcaggtgatgaaacttacctgagagatatgaaatttgatgttaacattgctttaagctcagtgaacgatcatgggaatacaatgcttcatcttgctgcagccgcgggtcacaccgacttagtgtgttatatactcaatgcgtacccaggtctgcttatgaagtcaaattccatgggggaagttgctctccatgttgcagcaggtgcaggccatctcgctgttgttgaggctctggttagttttatcaaagatatatcttgtaataagcctggtgttgccaaaaagatatactttgccaaggacagacaccaagacaatgctttacatgtctctttaaaaagaaaacatttgaaggtggcttcctgtttggtttgtgcagagcaaagtttgtcttttgtagcaaacaacgatggggtttctcccttgtatttagctgttgaagctggacaggctgatcttgcaaaaacaatgtggcaacattcaaataatggatcaagtagcacatctactttagcttcaaagattggaggaagatccatagtacatggcgcgatgaaggctaggagaaaagatattcttgttgctatacttagtgaagatgcaagtcttattaactttagagatgaaggaaggacttgtctttcttttggagcatccttagggtattatgaagggttttgctatctgttagacaaggctctagacagtgtttatgtcagtgatgatgatgggtcctttccaattcatatggccgtgaagtatggttatgtcaaaattctcaaggcaattcttaaacgttgtccagacgcacttgagttacttgacagagaaaatcaaaatgttcttcatgttgcggcaaagaatggaaaaatcgaagtcctcaaatttattttaagatgttgtaaggataagaacaaggaaaagttgattaatgaagaagatgcaaatggaaacacgccattgcatttggccaccaaaaactggcaccctaaagttgtgagtatgctcacttgggacaacagagttgacctgaaaacgctgaaccatgacggtgtcacagctctagatatcgctgagaaaaacatggattccagctacacattttttgagaggttgacttggatggctttgatatctgctggtgcaccaagaggtcccaaactaatattatcgactccagtaacacaaaactcagatggtggaaagtacaaagatcgggttaatacacttctgttagtggccactcttgtagccactatgactttcactgcagggtttacactaccagggggttacaatggttctgttcccaactttggaatggcaacattggccaagaaaacagcgttccaagtgtttctggtattcgacaccttggcgatgtactgttctatcataacaatagttgctctcatttgggcgcaattgggcgatctttctcttatcatgaaagctttcaaccttgcgttgccacttctcggacttgcgcttacatccatgtcaatagcttttatggctggcacgtatgctgcagtaagccacctccctttgcttgcgtatttcatattgggcatcggcttgatcttcctcttggttttgctgctgatcattattccatatgtgtccccacattctcctacccaaccctttcttagacacatcttttactacccctatttccttatgcttttggtcgctggtgacaacagaaacaagtactaaagctatccgcggtaaatcactacgcagctttc

SEQ ID NO: 1558 - protein, 628 aa, Arabidopsis thaliana
  G2022,AKR domain coordinates 130-412
MGRSDLDFDRQKKDASSRMFYADETGRTHSLDLSTLFNDTSETVPMGPKTIAAVRAGDETYLRDMKFDVNIALSSVNDHGNTMLHLAAAAGHTDLVCYILNAYPGLLMKSNSMGEVALHVAAGAGHLAVVEALVSFIKDISCNKPGVAKKIYFAKDRHQDNALHVSLKRKHLKVASCLVCAEQSLSFVANNDGVSPLYLAVEAGQADLAKTMWQHSNNGSSSTSTLASKIGGRSIVHGAMKARRKDILVAILSEDASLINFRDEGRTCLSFGASLGYYEGFCYLLDKALDSVYVSDDDGSFPIHMAVKYGYVKILKAILKRCPDALELLDRENQNVLHVAAKNGKIEVLKFILRCCKDKNKEKLINEEDANGNTPLHLATKNWHPKVVSMLTWDNRVDLKTLNHDGVTALDIAEKNMDSSYTFFERLTWMALISAGAPRGPKLILSTPVTQNSDGGKYKDRVNTLLLVATLVATMTFTAGFTLPGGYNGSVPNFGMATLAKKTAFQVFLVFDTLAMYCSIITIVALIWAQLGDLSLIMKAFNLALPLLGLALTSMSIAFMAGTYAAVSHLPLLAYFILGIGLIFLLVLLLIIIPYVSPHSPTQPFLRHIFYYPYFLMLLVAGDNRNKY

SEQ ID NO: 1559 - DNA, 2190 bp, Arabidopsis thaliana
  G2023,family:AKR
aacgacagctttacacgaaacaaacaaggcacagagattaatgacgagggcgtttcatctgatcattgactgcattactggagacactggatctattcaaatgctcgttacgaatctttatgacttacccggagaatatgtgtcgatgaatcctgagatctttagcgcaatgagagcagggaacgtaaagtttttggataagatgaagactaacaacaatacaccattggcatgtttcaggaacgaaacaggagatttcactcttcaccttgctgctgcttggggtcgacttgagctagtgaagagaatcgtctctgaatgcccatgtcttcttttggaaacaaactccaaggaccagattccgcttcatgccgctgccgctgctggccgtttagctgttgttgaggcttttgttgcgagagtaaatgaaatttcagatggactctctgaagaagagagggagagagtgaatctatatgctatgaaggatatagatggaaataccgctctgcacttagccttgaaaggcggccatttgaagacagctgcatgtctggtaaaggccaaccaccttgcttcgtttcttgcaaataaccatggagtatctcctttgtttacggctataattgctggaagtctaaccctagtggaagcaatgatgtacgttcctggacagacatgtaacttggcatcaaagttagaagggagaaagtcgcttgtacacgcggctctaaaggccaaaaactcagatatccttgatgttattctcagtgaagacccaagtcttgtcaatgaacgagatgaagaaggacggacctgcctttcagttgcagcatacgtagggtactataaaggggtagtcaatctcttacaccgatcaacatcaaatgtctttgagtgtgatgatgatggttcctatccaatccacatggcagtggagaagggtcgcgtcaaaattttcctaaagcttctcaagtgttgtcccgattcacaatacctacttaacaaacaaggtcagaacattcttcacattgcggcaaaaagtgggaaaactggaacttacctattacaagtcatcaaggcttatgatttgataaagaatgatctgattatggagcaagatgtggatgggaatacacctctgcacttagccaccttaacgtggcgtcctcgaactgttaatatacttaataagttcactttgggaaaccacctacatatacgtaacaaagatggcttgagtgctctggatatagcggagtcgaatctgcagtccaattacgtctttcgagagagaatgacgttgatggtcttattgtgcacttgttcgccaagagggtttaaaatgatacccacaagtggaataacattaaaaagcagatcagaaaaagtagccggtaacaaatacaaagacagtatcaatgtacttctacttgtggcaactctagtagctactgtggcatttgctgcaggtattgccataccaggaggatttagtagttctactccaaaaaggggaattgcaattttggacgatgatgacttcctctcgatttttctggtgtttaacacattggcgatgcaaagctctgttctggcaatagttgctctaatatgggcacaactgggggatccagtacttgttcataaaacctttcatttggcattgccagcactctttgtttctctagtttcaatgtcctcagcattcttctgcggcgtggtggctacaacaaagcacaatccttggctttttgatagcattatctttatctctatcatcttcctttttgtggtagcttatctccttgccccttacgctatccctcagtttccgggcactccttttcttcaaagaattactaaatgttatctcgactttatgttgttgtttgttaatgaagatgatgttgatattgtctgcgagaagaagcaggagaccgtccatctttatgtcgcgaactaagtcgaaaggtaaaatatcctaaaaaatgtctttaaagaaataatatcatttcatctgtttgattaagatgttgtttaaacgttattggcttttcggtgtttcgtgatttatctatgagtttttatttatggtttccatcattccatgtactctattttgtcaaaatacataatatattgtgtggagactctctagagctagagaatggagcttctgttgctatg

SEQ ID NO: 1560 - protein, 641 aa, Arabidopsis thaliana
  G2023,AKR domain coordinates 70-394
MTRAFHLIIDCITGDTGSIQMLVTNLYDLPGEYVSMNPEIFSAMRAGNVKFLDKMKTNNNTPLACFRNETGDFTLHLAAAWGRLELVKRIVSECPCLLLETNSKDQIPLHAAAAAGRLAVVEAFVARVNEISDGLSEEERERVNLYAMKDIDGNTALHLALKGGHLKTAACLVKANHLASFLANNHGVSPLFTAIIAGSLTLVEAMMYVPGQTCNLASKLEGRKSLVHAALKAKNSDILDVILSEDPSLVNERDEEGRTCLSVAAYVGYYKGVVNLLHRSTSNVFECDDDGSYPIHMAVEKGRVKIFLKLLKCCPDSQYLLNKQGQNILHIAAKSGKTGTYLLQVIKAYDLIKNDLIMEQDVDGNTPLHLATLTWRPRTVNILNKFTLGNHLHIRNKDGLSALDIAESNLQSNYVFRERMTLMVLLCTCSPRGFKMIPTSGITLKSRSEKVAGNKYKDSINVLLLVATLVATVAFAAGIAIPGGFSSSTPKRGIAILDDDDFLSIFLVFNTLAMQSSVLAIVALIWAQLGDPVLVHKTFHLALPALFVSLVSMSSAFFCGVVATTKHNPWLFDSIIFISIIFLFVVAYLLAPYAIPQFPGTPFLQRITKCYLDFMLLFVNEDDVDIVCEKKQETVHLYVAN

SEQ ID NO: 1561 - DNA, 2256 bp, Arabidopsis thaliana
  G2025,family:AKR
atggcacgacgaggattaaggatggacaactctgaagcacatctagatagaattgaggcacagaggtcaacagatgaccaacataaacgaagatgcttccctgtgaatgtgataaaaaatctaggcacactcagttcacgcagtttccttcgacgcagaggagatgaagccacaccacctacgactacgatagacattgaatctgtgccaaagttccttaccactctcagattgttggatctttacaaccaccccggtgaatatgtggcaatgaattcagagatctccagcgcaatgcgagctgggaacaaagaatttctggagaagatggaaagctacgaaacaccaatgtcatgcttcaagaacaacaaaggagattccattcttcaccttgctgctgcttttggtcatcttgagctagtaaagagcatagtctctaaattcccatctcttctgttggagttaaattttaaggatcagcttccgcttcatgtggctgctcgtgatggtcatttaacagttgttaaagctcttgtagcatcggtaacattttgttcagatagactggctgaagaagatagggagaggctgaatccatatattctaaaggacaaaaatggagatactgctctccactcagccttgaaagacctccatgaaaaaacaaaagaactccatgaaaaaacaaaggatatgcattggctacgacgtagcaaatccaagtcactttctaatgaatctacacacctaatggagacagctgcttgtctagtcaatgcgaaccaagatgtttcgtttcttgcaaataaagatgaaatctcccccttgtatttggcagttgaagctggtaacgtatcacttgtaaatgcaatgttgaacagccatgttaataacgttcaagacaaaacctttaacttagccacacaattgaaagggagaaaatcgcttgtgcatgcagctttaaaggcaaagaatacagatgttcttgatgttattctcggtaaatacccgagtcttgtcaaagagcgagacgaaaaaggacgaacttgtctttcggttggagcatctgtagggttttatcaaggcatatgcaagctgttagacacatcaacgctaagcatctttgattgcgacgatgatggttcatttcccatccataaggcagtggagaaaggtcatgagaatgttgttaaagagcttctaaaacgttttccggattcagtagagcagcttaacaaagaaggtcagaacattttccacatatcagcaaagagtggcaaatccacattgtttcttatggaacatatcaataaagtcgatacgaagaatcatcttatggaggagcaagatatggatgggaatacacctttgcacctggccaccataaattggcgccctaaaactgttcgtatgcttactaaatttctttccatcagaaaaaaactcttggataaacataactccgttggcttgagacctctggatatcgcagagataaatctgcagtctgactacgtttttcgagagagaatgactttgatggtcttgctaggcgtttacaatctaagacagagaggtatttctttgctaccgactagcgggatgacactaagaagtagatcagaaaaactaggtgatggtgaaaaatacaaagaccgtgtcaacattcttctactggtggcagctcttgtagccactatgacgtttgctgcaggttttacaatgcccggtggctttagcagctctgctccaaacactggcatggctattttggtcgatgaccgttacctcacaacatttattatgaatgacactattgcaatgcttacctcagttttagcaatagttgctcttatctgggcacagttaggagatccagaactcgcgcacagagcgtttcatttggctttaccagcactcttcgttgctctactcttcatgtgtttcacattcttttatggcgttctggctacaatacagcataacatcgtgctttcacgcatcataagctttgtatttattatcttatttattatgaccggaaccctccttaccccttacgtgatcccgcaggtttacggccttcctattattggagttttgactagttcatatcttgattttctattgctgtttgttaatgaagatgatgatgaaaaacattacaccaccggctcatctcacacgtgtgtgaagagtggggagtccatgggatcttcaagcggggtccaagcggaaaagtcgaaagtgctttaa

SEQ ID NO: 1562 - protein, 751 aa, Arabidopsis thaliana
  G2025,AKR domain coordinates 124-484
MARRGLRMDNSEAHLDRIEAQRSTDDQHKRRCFPVNVIKNLGTLSSRSFLRRRGDEATPPTTTIDIESVPKFLTTLRLLDLYNHPGEYVAMNSEISSAMRAGNKEFLEKMESYETPMSCFKNNKGDSILHLAAAFGHLELVKSIVSKFPSLLLELNFKDQLPLHVAARDGHLTVVKALVASVTFCSDRLAEEDRERLNPYILKDKNGDTALHSALKDLHEKTKELHEKTKDMHWLRRSKSKSLSNESTHLMETAACLVNANQDVSFLANKDEISPLYLAVEAGNVSLVNAMLNSHVNNVQDKTFNLATQLKGRKSLVHAALKAKNTDVLDVILGKYPSLVKERDEKGRTCLSVGASVGFYQGICKLLDTSTLSIFDCDDDGSFPIHKAVEKGHENVVKELLKRFPDSVEQLNKEGQNIFHISAKSGKSTLFLMEHINKVDTKNHLMEEQDMDGNTPLHLATINWRPKTVRMLTKFLSIRKKLLDKHNSVGLRPLDIAEINLQSDYVFRERMTLMVLLGVYNLRQRGISLLPTSGMTLRSRSEKLGDGEKYKDRVNILLLVAALVATMTFAAGFTMPGGFSSSAPNTGMAILVDDRYLTTFIMNDTIAMLTSVLAIVALIWAQLGDPELAHRAFHLALPALFVALLFMCFTFFYGVLATIQHNIVLSRIISFVFIILFIMTGTLLTPYVIPQVYGLPIIGVLTSSYLDFLLLFVNEDDDEKHYTTGSSHTCVKSGESMGSSSGVQAEKSKVL

SEQ ID NO: 1563 - DNA, 1153 bp, Arabidopsis thaliana
  G2065,family:MADS
aaccacacaaaacaaaacaaaaaaacatattgatggggatgaagaaggtaaagctatctttgatagctaatgaaagatcaaggaaaacatccttcatgaagaggaaaaacgggatattcaagaaactccacgagttgtcaactctatgtggtgtccaagcttgtgctctcatctatagtccattcataccggttccagagtcatggccgtcaagggaaggtgctaaaaaggtagcttcaaagtttctggagatgccgcggacagcccgaaccaggaagatgatggatcaagaaacccatcttatggagaggattaccaaagcaaaagagcaactaaagaatttggctgctgagaaccgagaattacaggttagacgatttatgtttgattgtgttgaaggcaaaatgtcccagtatcgttatgatgcaaaagaccttcaagatttgctatcttgtatgaatctatatctcgatcagcttaacggaaggatcgagtccattaaagaaaacggtgagtcgttgttgtcttccgtctctccttttcctactagaattggtgttgacgaaattggtgatgagtcgttttccgactctcctattcattctacaactagggttgtagatactcctaatgctaccaatcctcatgttcttgcgggcgatatgactccttttcttgatgcggacgcaaatgcggtaactgctcccagtcgattttctgatcatattcaatatgaaaatatgaatatgagtcaaaatctgcatgaaccgtttcaacaccttgttcctactaacgtttgtgatttttatcaaaatcagaatatgaatcaggttcaataccaggctcctaataatctgtttaatcagattcaacgagaattctacaacataaatttgaatctgaatttgaatctgaattcaaatcagtatctgaatcaacaacaatcattcatgaatccgatggtggaacaacatatgaatcatgttggagggcgtgaaagcattcctttcgtggacagaaactactacaactacaatcaactaccagccgttgatcttgcttccaccagttacatgccttcaaccaccgatgtttatgatccttacatcaacaacaatctctaatcacaaaagacggagattttctagtttaa

SEQ ID NO: 1564 - protein, 363 aa, Arabidopsis thaliana
  G2065,MADS domain coordinates 1-57
MGMKKVKLSLIANERSRKTSFMKRKNGIFKKLHELSTLCGVQACALIYSPFIPVPESWPSREGAKKVASKFLEMPRTARTRKMMDQETHLMERITKAKEQLKNLAAENRELQVRRFMFDCVEGKMSQYRYDAKDLQDLLSCMNLYLDQLNGRIESIKENGESLLSSVSPFPTRIGVDEIGDESFSDSPIHSTTRVVDTPNATNPHVLAGDMTPFLDADANAVTAPSRFSDHIQYENMNMSQNLHEPFQHLVPTNVCDFYQNQNMNQVQYQAPNNLFNQIQREFYNINLNLNLNLNSNQYLNQQQSFMNPMVEQHMNHVGGRESIPFVDRNYYNYNQLPAVDLASTSYMPSTTDVYDPYINNNL

SEQ ID NO: 1565 - DNA, 1107 bp, Arabidopsis thaliana
  G207,family:MYB-(R1)R2R3
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 1566 - protein, 304 aa, Arabidopsis thaliana
  G207,MYB-(R1)R2R3 domain coordinates 6-106
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 1567 - DNA, 764 bp, Arabidopsis thaliana
  G208,family:MYB-(R1)R2R3
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaataatttgtcaaaaaaatcccaaaaaatgggtttgttaaa

SEQ ID NO: 1568 - protein, 236 aa, Arabidopsis thaliana
  G208,MYB-(R1)R2R3 domain coordinates 14-116
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 1569 - DNA, 1126 bp, Arabidopsis thaliana
  G2106,family:AP2
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaa

SEQ ID NO: 1570 - protein, 352 aa, Arabidopsis thaliana
  G2106,AP2 domain coordinates 56-139,165-233
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPVNFLGILLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 1571 - DNA, 1828 bp, Arabidopsis thaliana
  G2110,family:WRKY
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 1572 - protein, 528 aa, Arabidopsis thaliana
  G2110,WRKY domain coordinates 239-298
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 1573 - DNA, 1321 bp, Arabidopsis thaliana
  G2128,family:GARP
cgtcgacagtttactctcttggaacttctgagagaagcaaattagatttaaacttacagttgcacagactttatgtattaccaaaaccagcaccaaggaaagaacatcctctcatcttcaagaatgcatataacttctgaaaggcatccattccttagagggaatagtccaggtgattctggacttatcctatcaaccgatgcaaagccacgcctaaaatggactccagatcttcatgagagattcattgaagcagtcaatcaactcggtggagcagataaagctactcctaagacaatcatgaaagtcatggggattccaggccttaccttataccatctcaaaagtcatcttcagaaatacaggctgagcaagaatctcaacggacaagctaacaacagcttcaacaaaataggtataatgaccatgatggaagaaaagactcctgatgcagacgaaattcaaagcgagaatttaagcattggaccacagccaaacaagaattcaccaataggtgaagcactgcaaatgcaaatagaggtccaaagaaggcttcatgagcaacttgagcttaggatagaggctcaagggaagtacctgcaatcggttttggagaaagcacaagagactcttggaagacagaacctcggtgcagctgggatcgaagctgccaaagttcaactctcggaactagtatctaaagtatcagcagagtacccaaactctagtttcctagaaccaaaagaacttcaaaacctatgctcacaacagatgcaaacaaactatccacctgattgctctcttgaaagttgcctgacctcaagcgagggaacgcagaaaaactcgaaaatgctagagaacaacagattaggactaagaacgtatattggtgattcaacatcggagcagaaagagattatggaagaaccattgttccaaagaatggagctcacatggacagaaggtctaagagggaatccatatctttcaacaatggtgagtgaagcagaacaaagaatctcatattcagaaagaagtccaggtagattatcaataggagtaggattgcacggacacaaaagccaacatcaacaaggcaacaatgaggatcataagcttgaaacacgaaaccggaaaggcatggattcaacaacagagctagatctcaacacacatgttgaaaactattgtacaacgcgtacgaaacagttcgacttgaatggtttcagctggaactgagaatagattaaccaaaaagttaaaagagagtttcaatcatttctgagttcacacaggagaagaacccctattagcggccgct

SEQ ID NO: 1574 - protein, 388 aa, Arabidopsis thaliana
  G2128,GARP domain coordinates 49-100
MYYQNQHQGKNILSSSRMHITSERHPFLRGNSPGDSGLILSTDAKPRLKWTPDLHERFIEAVNQLGGADKATPKTIMKVMGIPGLTLYHLKSHLQKYRLSKNLNGQANNSFNKIGIMTMMEEKTPDADEIQSENLSIGPQPNKNSPIGEALQMQIEVQRRLHEQLELRIEAQGKYLQSVLEKAQETLGRQNLGAAGIEAAKVQLSELVSKVSAEYPNSSFLEPKELQNLCSQQMQTNYPPDCSLESCLTSSEGTQKNSKMLENNRLGLRTYIGDSTSEQKEIMEEPLFQRMELTWTEGLRGNPYLSTMVSEAEQRISYSERSPGRLSIGVGLHGHKSQHQQGNNEDHKLETRNRKGMDSTTELDLNTHVENYCTTRTKQFDLNGFSWN

SEQ ID NO: 1575 - DNA, 1065 bp, Arabidopsis thaliana
  G2131,family:AP2
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 1576 - protein, 313 aa, Arabidopsis thaliana
  G2131,AP2 domain coordinates 50-121,146-217
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 1577 - DNA, 485 bp, Arabidopsis thaliana
  G2133,family:AP2
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 1578 - protein, 143 aa, Arabidopsis thaliana
  G2133,AP2 domain coordinates 10-77
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 1579 - DNA, 539 bp, Arabidopsis thaliana
  G2138,family:AP2
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 1580 - protein, 161 aa, Arabidopsis thaliana
  G2138,AP2 domain coordinates 76-148
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 1581 - DNA, 1353 bp, Arabidopsis thaliana
  G2149,family:HLH/MYC
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttat

SEQ ID NO: 1582 - protein, 362 aa, Arabidopsis thaliana
  G2149,HLH/MYC domain coordinates 286-344
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 1583 - DNA, 1843 bp, Arabidopsis thaliana
  G2158,family:ACBF-like
aaccaaatctaatcctctctctctcggtctcctccattacctaaacaaaccctttccaacacatacatatcgagagagagagagaccgaagtttccgagtctcgtaaccagatcggatccgaaagttccatactttaaaaagatgcagacaccaaacaacaacggttcaacagattcagtgttaccaccaacatcagccggaacaacaccaccaccaccgttgcagcaatcaacaccaccaccgcagcagcaacaacaacaacagtggcaacaacaacaacaatggatggctgcgatgcagcaataccctgcagctgctatggctatgatgcaacaacaacagatgatgatgtatcctcaccctcaatacgctccttacaatcaagctgcttatcaacagcatcctcagtttcaatacgctgcttatcaacagcagcagcagcaacatcaccagagtcagcagcagccacgcggtggatctggtggtgatgatgtcaagactctttgggttggtgatcttcttcattggatggatgagacttatctccatacctgtttctctcacaccaatgaggtttcttctgtgaaagttatacgcaacaagcaaacttgtcaatctgaaggatatgggtttgttgagtttctttcacgttcagcagctgaggaagctcttcagagctttagcggtgttacaatgccgaacgcggaacagcctttccgtttaaactgggcatctttcagtactggtgagaaaagagcatcagagaatggtcctgacctatccatatttgttggagatttggctccagatgtgagtgatgctgtcttgcttgagacttttgctggtagatatccatctgtcaaaggtgctaaagttgtgattgattccaacactgggcgttccaaaggttacgggtttgttaggtttggtgatgagaatgagcgatcaagagctatgacagaaatgaatggtgctttctgttcaagcaggcaaatgcgtgttggtatcgcaaccccgaaaagggctgctgcttacggccaacaaaatggttcacaagctcttacacttgctggtggacatggagggaatggttcaatgtctgatggagaatcaaataactcaacaatatttgttggcggtcttgatgctgatgttactgaagaagacctcatgcaacctttttccgattttggggaggttgtttcagtgaagatcccagtagggaaaggatgtggctttgtccaatttgctaacaggcaaagtgctgaggaagccatcgggaacttgaacgggacagtcattgggaagaacactgtccgcctttcatggggaagaagccccaacaaacagtggagaagtgactctggcaaccaatggaatggaggatattcaagaggtcaaggatacaacaatggatatgccaatcaggactcaaacatgtacgctactgcagcggctgcagtcccgggagcttcttgaaagtgttggtatgtctctatcatcagaaaccctgtgagtcctggacttacgggtattgggataaaaacaaaccgttgggtgatcaaagtgatccatccgatgatagttgttggttcagaggttagctcgcaccatcgaaactaaaacctctagtgtccaaagagggttttgtatcctggatttgaatcttgcttatcttgctgtctcagtctctgtcaaaattttggggtcgtctgatacttgaattttttattttcagttttttttttgagttaatttgtctttgttactgagacttcctcaaagtcagagcttggtccacaataagtaatttcctaaatcgtttggatcaaaaaaaaaaaa

SEQ ID NO: 1584 - protein, 445 aa, Arabidopsis thaliana
  G2158,ACBF-like domain coordinates 120-300
MQTPNNNGSTDSVLPPTSAGTTPPPPLQQSTPPPQQQQQQQWQQQQQWMAAMQQYPAAAMAMMQQQQMMMYPHPQYAPYNQAAYQQHPQFQYAAYQQQQQQHHQSQQQPRGGSGGDDVKTLWVGDLLHWMDETYLHTCFSHTNEVSSVKVIRNKQTCQSEGYGFVEFLSRSAAEEALQSFSGVTMPNAEQPFRLNWASFSTGEKRASENGPDLSIFVGDLAPDVSDAVLLETFAGRYPSVKGAKVVIDSNTGRSKGYGFVRFGDENERSRAMTEMNGAFCSSRQMRVGIATPKRAAAYGQQNGSQALTLAGGHGGNGSMSDGESNNSTIFVGGLDADVTEEDLMQPFSDFGEVVSVKIPVGKGCGFVQFANRQSAEEAIGNLNGTVIGKNTVRLSWGRSPNKQWRSDSGNQWNGGYSRGQGYNNGYANQDSNMYATAAAAVPGAS

SEQ ID NO: 1585 - DNA, 1812 bp, Arabidopsis thaliana
  G2159,family:DBP
gaagcagagaagaggaaaaaagctgtgactttcatacattactctccctctccatctctctcgttgtcacatatcagtatatcacaaaacaaattgcagccattcacatctttctcttccatctctcaacattctctttctctctgtaaaatggagaaaccagtgtttgcaccatggcgttccgaccaagttttccggccaccggagacaccattagagccgatggagtttctctctcgctcctggagcgtatcagctcacgaagtctccaaagctctcactccttctcagcaactcctctcaaaagcctcaatcgaaaacaccaccgtcattctcgaagaacccatcgccgccggcgagaccgaaacggaggacaacagcttcgtctccggaaaccctttctccttcgcttgctcagaaacttctcagatggtcatggatcgtatcttatctcagtctgaagtgtcgccacgaacatctggtcggctttctcatagcagcggtcctctcaatggttctttaaccgacagtcctccgatttcgccgcatcaagtcgacgacattaagcaattttgccgatcaaacaacaatttcaactctcaataccgttcaacgggaacaactccgggacctatcactgcaacaactacacagtccaagacagttggacggtggttgaaagacaggagggagaaaaagaaggaagagatgagagcacacaatgctcagatacatgctgctgtatcagtagctggtgtggcagccgcggtggctgctatcgcggctgcaactgctgcttcgtcgagtgctggaaaagatgagaatatggctaagacggatatggctgtggcttctgctgcaacacttgtggctgctcaatgtgtggaagctgctgaagttatgggagctgagagggatcatttagcttccgttgttagttctgctgttaatgttcgatctgcgggagatatcatgacattaaccgctggagcagccacagcgttaagaggagtggctacattgaaggctagagctatgaaggaggtgtggcacattgcatcagttattccaatggataaaggaatcaatctcggaggttgcagcaatgttaatggtaacgggagctatgtcagctcaagcagcagtcatagtggcgaatttctagttgaggataatttcttgggacattgcaatagagaatggcttgctcgaggtggccaacttcttaaacgcacccgcaaaggtgatcttcattggaaaatagtttcagtttacataaacaggctaaatcaagttatattgaagatgaagagcaggcatgtaggagggaccttcacgaagaagaacaaaaatgttgtgattgatgtgatcaaaaacgttcaagcttggccaggccgccatttgctggaaggaggagaggatttgagatactttgggttaaagacggttccgcgagggattgtagaatttcagtgcaagagccagagagagtatgaaatgtggacacaaggtgtctcaaggcttattgctgttgctgccgagaggaataacagatataggatatgaagggagtagtagttttaagagttcagagctactttttgaggggtgatatctaacttatggggccaaattataacttggagaaagttaagggtgttttctttagagtaatgtctttttgtaaggtatataggattaaatgtggcctctataagggtagctagtgaaacaaatcttggtgtttgtatatatattttttttttgggaaaaaagtttaatatcaaatttttaatttaaaaaaaaaaaaaa

SEQ ID NO: 1586 - protein, 471 aa, Arabidopsis thaliana
  G2159,DBP domain coordinates 170-294
MEKPVFAPWRSDQVFRPPETPLEPMEFLSRSWSVSAHEVSKALTPSQQLLSKASIENTTVILEEPIAAGETETEDNSFVSGNPFSFACSETSQMVMDRILSQSEVSPRTSGRLSHSSGPLNGSLTDSPPISPHQVDDIKQFCRSNNNFNSQYRSTGTTPGPITATTTQSKTVGRWLKDRREKKKEEMRAHNAQIHAAVSVAGVAAAVAAIAAATAASSSAGKDENMAKTDMAVASAATLVAAQCVEAAEVMGAERDHLASVVSSAVNVRSAGDIMTLTAGAATALRGVATLKARAMKEVWHIASVIPMDKGINLGGCSNVNGNGSYVSSSSSHSGEFLVEDNFLGHCNREWLARGGQLLKRTRKGDLHWKIVSVYINRLNQVILKMKSRHVGGTFTKKNKNVVIDVIKNVQAWPGRHLLEGGEDLRYFGLKTVPRGIVEFQCKSQREYEMWTQGVSRLIAVAAERNNRYRI

SEQ ID NO: 1587 - DNA, 1674 bp, Arabidopsis thaliana
  G2184,family:NAC
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactag

SEQ ID NO: 1588 - protein, 557 aa, Arabidopsis thaliana
  G2184,NAC domain coordinates 17-147
MADSSPDSCFKGGKFSAPGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDELGRCKNPQEYYALYKLFKKSGAGPKNGEQYGAPFQEEEWVDDDNEDVNAIAVAVPEQPVVRYEDARRVDERRLFNPVILQLEDIDELLNGIPNAPGVPQRCIPQVNSEEELQSTLVNNSAREFLPNGQQYNRPSSFDSLETAEVTSAPLVFEKEDFIEMDDLLLIPEFGASSTEKAAQFSNHGEFDDFNEFDQLFHDVSMSLDMEPIDQGTSANLSSLSDSANYTSDQKQQLLYQQFQDQTPENQLNNIMDPSTTLNQITSDIWFEDDQAILFDQQQSFSGAFASPSSGVMPDSTNPTMSVNAQGHEIQNGGGTTSQFSSALWALMDSIPSTPASACEGPLNRTFVRMSSFSRMRFNGKANGTPVSTTIAKKGIRNRGFLLLSIVGALCAIFWVLVATVRVSGRSLLLKD

SEQ ID NO: 1589 - DNA, 910 bp, Arabidopsis thaliana
  G2216,family:bZIP-NIN
gtgttcttaatgcagcgagttagcaaatcctttcttcgagttggaagacgagatgcttccttctgctacctctagtaattgttttacttctgcctcaagctttctggctttacctgatcttgaacccatctccattgtgtctcatgaagatatacttagtgtgtatggttctgcttcatggaccgcagaagagacgatgttcgtttctgattttgcgaaaaagagtgaaaccacaactaccaagaagaggagatgcagagaagaatgtttttctagttgttctgtttcaaagacattgtcgaaggaaaccatctcattgtacttttacatgccgataactcaagcggctagagagcttaacattggtttaactcttttgaagaagagatgccgcgaattgggtattaaacgttggcctcatcgtaagctcatgagcctacaaaaactcatcagcaatgtcaaggagctagagaagatggaaggggaagaaaatgaagataagctaagaaacgctttggaaaagctcgagaaggagaagaaaacgattgagaagttaccagatttgaagtttgaggataagacaaagagattgagacaagcttgtttcaaggctaaccataagaggaagagaagaagtggcatgtccacgcccatcacatcatcatcttcttctgcttctgcttcttcttcttcttactcttctgtttcgggttttgagagataataggtgctcgatggtctttgatgaagaggtatgagaagatgatgataaagaggtgaaggatctcttatgaagtttctctagtgtgggttcttctatttgtttgtgaatgtgttgtgtatggtttattgtattcgactctaaattacaaaacgtttttgactcattaatattaaaattactactaat

SEQ ID NO: 1590 - protein, 223 aa, Arabidopsis thaliana
  G2216,bZIP-NIN domain coordinates 90-139
MLPSATSSNCFTSASSFLALPDLEPISIVSHEDILSVYGSASWTAEETMFVSDFAKKSETTTTKKRRCREECFSSCSVSKTLSKETISLYFYMPITQAARELNIGLTLLKKRCRELGIKRWPHRKLMSLQKLISNVKELEKMEGEENEDKLRNALEKLEKEKKTIEKLPDLKFEDKTKRLRQACFKANHKRKRRSGMSTPITSSSSSASASSSSYSSVSGFER

SEQ ID NO: 1591 - DNA, 1206 bp, Arabidopsis thaliana
  G223,family:PMR
atggaggaaaaaagagaaaacactaactcgatctacatagttcccgagctattggaagatattttccttcgattgcctttgaaatcaatcctgaaattcaaaaccgtatcaagacaatggagatcaatcctggaatccaagttgttcgtggagaggcgcgggaatcttcaaaagcaccaccggaaaatcctagctgcttacaactgcaactactttatgcggccgagtatcttccctgagtctcgtttcgaaggggacgaagagatcgtttatctacactgcgacgccgcgcaaccctcgatgacttgcgacggtttactctgcatcaccgaacctggttggtttaacgttttgaacccatccgctggacaactccggcgattccctcccggcccaggtccagtaaaaggaccgcaggaaaattggctattgggattcggtagagacaacgttacgggcaggtataaaatagtgaggatgtgttttcatgattgttatgaatttggtattcttgatattgaaactggtgtatggagcaaactgaggtcacctcctcataatatgcttccgggaagtaaatcggtgtgtgtgaatggatcaatctactggttacaaattagtgcgggttacataatattagctatggatcttcacgaagaaagctatcatggtgtccaccaccttccggctacgtgggtcacgcaggaaacccagttagtgaaccttgaggaccgtctagccatggccatgaccaccaacgttgggcctgaatggatactagagatctggagcatggatatagaaggaaaaggatggagcaagggttactcgtggagcaagagttactccataagtttagcccatggagttggtttttcctggccatggcagaaaaggtggttcactcctgtgtgggtttctaagcaagggaatcttctcttctacgataatcacaagaggctattcaaatattattcaggaacagatgagattcgttgtctctcctctaacatctgtgttatatcttcttatgttgaaaatttggccccacttccgttaaaaccaagccatacgcatcatgatcttgggaattcgaattccaagttcagcacgtccagatgccacttgtttccgacgcgaggttcttggatatccaaagttttgtttacctctatactatttgggtatatctgcttacctctctag

SEQ ID NO: 1592 - protein, 401 aa, Arabidopsis thaliana
  G223,PMR domain coordinates 16-222
MEEKRENTNSIYIVPELLEDIFLRLPLKSILKFKTVSRQWRSILESKLFVERRGNLQKHHRKILAAYNCNYFMRPSIFPESRFEGDEEIVYLHCDAAQPSMTCDGLLCITEPGWFNVLNPSAGQLRRFPPGPGPVKGPQENWLLGFGRDNVTGRYKIVRMCFHDCYEFGILDIETGVWSKLRSPPHNMLPGSKSVCVNGSIYWLQISAGYIILAMDLHEESYHGVHHLPATWVTQETQLVNLEDRLAMAMTTNVGPEWILEIWSMDIEGKGWSKGYSWSKSYSISLAHGVGFSWPWQKRWFTPVWVSKQGNLLFYDNHKRLFKYYSGTDEIRCLSSNICVISSYVENLAPLPLKPSHTHHDLGNSNSKFSTSRCHLFPTRGSWISKVLFTSILFGYICLPL

SEQ ID NO: 1593 - DNA, 1164 bp, Arabidopsis thaliana
  G224,family:PMR
atgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcacgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtag

SEQ ID NO: 1594 - protein, 387 aa, Arabidopsis thaliana
  G224,PMR domain coordinates 7-114
MIYVVPDLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFPCSPNHHVPSDRIRFQFRDELYLTSFPGNWEMGFGRDKFNGSYKVVRMCFSPVEKCEVLDVETGEWSELNPPPNDIDVGRKSRFGILALDLHTLEFHNVSVPSTCCTMSAQMVNLDDRLAITKTNGAPEWELEILSLMDVDKEIWSKTYSITLASIIINHPWESSWFTVLTVSKLGNLVFCDNHKRLFKYNTETNEICCLSSDISVISPYLEDLVPLRLDSGHDHRDYKIRTSSCGLFSKHPEAGLFKEIITFRFVFATLVLVGYQYYRSLKFK

SEQ ID NO: 1595 - DNA, 407 bp, Arabidopsis thaliana
  G226,family:MYB-related
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 1596 - protein, 112 aa, Arabidopsis thaliana
  G226,MYB-related domain coordinates 38-82
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 1597 - DNA, 708 bp, Arabidopsis thaliana
  G2297,family:MADS
tttatagccaataaactcataattttgtttttctccaaaatgaaacccaagaaaaccaaaggaaaacaaaggattaacatcaagaaaattgaaaaagacgaagacagattggtcacattgtctaagcgtcgaaatggtatctacactaaactcagtgagctttccattctctgtggtgctgaagttgcgtttctcgggtattcttgctctggaaaaccatacacattcggcagtccgtccttccaagccgtggcagagcggtttctcaacggcgaggcctcgtcgtcttcttcatcatcgttgcaacgatcggtcatgaatgctcatcagcaagcgaagattcaagagctttgcaaagtatacaatagattggtggaggagataacggtggaagaagtcaaattaaagaagacggctgcattggcggagatgatgcccatgaatgaggatgcgtggtggaaagtggatccaaatgacgtgaaggatcgcgaagaggtgaagaagatgatggagaagcatcaagagctctatgagaaactgtgcgaggaagctgcttcaaggatcaagagaggacatgatgagaataataacaaatgatccataatcaagattttaattagtagatcatttgtgatcatcactagttaattatgagtcttaagaattatgttttttttttgtcttttgttttttatacattatgaattg

SEQ ID NO: 1598 - protein, 185 aa, Arabidopsis thaliana
  G2297,MADS domain coordinates 8-63
MKPKKTKGKQRINIKKIEKDEDRLVTLSKRRNGIYTKLSELSILCGAEVAFLGYSCSGKPYTFGSPSFQAVAERFLNGEASSSSSSSLQRSVMNAHQQAKIQELCKVYNRLVEEITVEEVKLKKTAALAEMMPMNEDAWWKVDPNDVKDREEVKKMMEKHQELYEKLCEEAASRIKRGHDENNNK

SEQ ID NO: 1599 - DNA, 930 bp, Arabidopsis thaliana
  G230,family:MYB-(R1)R2R3
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 1600 - protein, 309 aa, Arabidopsis thaliana
  G230,MYB-(R1)R2R3 domain coordinates 13-113
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 1601 - DNA, 916 bp, Arabidopsis thaliana
  G231,family:MYB-(R1)R2R3
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 1602 - protein, 266 aa, Arabidopsis thaliana
  G231,MYB-(R1)R2R3 domain coordinates 14-118
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 1603 - DNA, 858 bp, Arabidopsis thaliana
  G233,family:MYB-(R1)R2R3
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctag

SEQ ID NO: 1604 - protein, 285 aa, Arabidopsis thaliana
  G233,MYB-(R1)R2R3 domain coordinates 13-115
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 1605 - DNA, 1139 bp, Arabidopsis thaliana
  G234,family:MYB-(R1)R2R3
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 1606 - protein, 309 aa, Arabidopsis thaliana
  G234,MYB-(R1)R2R3 domain coordinates 14-115
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 1607 - DNA, 896 bp, Arabidopsis thaliana
  G2345,family:CAAT
agatcagatcaaatctctctctccatctccgtctcctcctccaatcatcatttctctctccgtctcccgctctttttcgaattctccttcttcttcagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaaggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttaccaaaaaaaaaa

SEQ ID NO: 1608 - protein, 176 aa, Arabidopsis thaliana
  G2345,CAAT domain coordinates 28-117
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQGSNMMVQMPGTE

SEQ ID NO: 1609 - DNA, 799 bp, Arabidopsis thaliana
  G2379,family:TH
cgccgtcactctcctcccggtgccgcacattagcaacactactcccgacgaatggagacgacgacgccgcagtcaaaatcaagtgtgtcccaccgaccgccgttgggaagagaagactggtggagtgaggaagcgacggcgacgctggtagaagcctggggcaatcgttacgtcaagctgaaccacggaaatctccggcagaatgactggaaagacgtcgccgacgccgttaactctagacacggtgataacagccgtaagaagaccgacttacagtgtaagaaccgggtcgatactttgaagaagaagtacaaaacagagaaagctaaactctcgccgtcgacttggcgtttctataaccgcctcgatgttctaatcggtcccgttgtgaagaaatcggctggcggagttgtcaaatcagcgccttttaagaatcatctgaatccaactggatcgaactctactggaagctctcttgaagatgatgatgaggatgatgatgaggttggtgattgggaattcgttgctaggaagcatcctcgtgtggaagaggtagatctgagtgaaggatcaacgtgtagggaactagctacggcgattctcaagtttggagaagtttacgagagaattgaagggaagaagcaacagatgatgattgagttggagaagcagagaatggaagtgacaaaggaggtagagttaaaacgaatgaacatgttgatggagatgcagttagagattgagaaatcaaagcaccggaaacgcgcaagtgcttcaggtaagaagaactcacattagg

SEQ ID NO: 1610 - protein, 248 aa, Arabidopsis thaliana
  G2379,TH domain coordinates 19-110,173-232
METTTPQSKSSVSHRPPLGREDWWSEEATATLVEAWGNRYVKLNHGNLRQNDWKDVADAVNSRHGDNSRKKTDLQCKNRVDTLKKKYKTEKAKLSPSTWRFYNRLDVLIGPVVKKSAGGVVKSAPFKNHLNPTGSNSTGSSLEDDDEDDDEVGDWEFVARKHPRVEEVDLSEGSTCRELATAILKFGEVYERIEGKKQQMMIELEKQRMEVTKEVELKRMNMLMEMQLEIEKSKHRKRASASGKKNSH

SEQ ID NO: 1611 - DNA, 957 bp, Arabidopsis thaliana
  G24,family:AP2
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 1612 - protein, 176 aa, Arabidopsis thaliana
  G24,AP2 domain coordinates 25-92
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 1613 - DNA, 1044 bp, Arabidopsis thaliana
  G2436,family:Z-CO-like
atgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgtcccttccttctaa

SEQ ID NO: 1614 - protein, 347 aa, Arabidopsis thaliana
  G2436,Z-CO-like domain coordinates 16-111
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 1615 - DNA, 1122 bp, Arabidopsis thaliana
  G2443,family:Z-CO-like
atgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctga

SEQ ID NO: 1616 - protein, 373 aa, Arabidopsis thaliana
  G2443,Z-CO-like domain coordinates 20-86
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 1617 - DNA, 890 bp, Arabidopsis thaliana
  G2456,family:YABBY
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaacgcggccgc

SEQ ID NO: 1618 - protein, 240 aa, Arabidopsis thaliana
  G2456,YABBY domain coordinates 25-63,148-195
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 1619 - DNA, 561 bp, Arabidopsis thaliana
  G2459,family:YABBY
catcttgtttggtcctatttctcagatcgatcatggctaactctgtgatggcaaccgaacagctctgctacatcccttgcaacttttgcaacataattcttgcggtgaatgtcccatgcagcagcctgttcgacatcgtgaccgtccgatgcggtcactgcaccaatctgtggtctgtaaacatggcagctgctcttcagtcgctttcacgccctaatttccaggcaacaaactatgcagtaccagagtatggatcctcctcaagaagccacacaaaaatcccttcaagaatttcaactcgtaccataactgagcaacggattgtaaaccgtcctccggagaagcggcagcgagtaccttctgcgtacaatcaattcataaaagaggaaattcagaggattaaggcgaataatccagacataagccacagagaagcattcagcactgctgccaagaattgggcacactttcctcatattcactttggtctaatgctggagagtaacaagcaagctaagatagcctaataattctcgagattaatggtaatataagtgttgg

SEQ ID NO: 1620 - protein, 164 aa, Arabidopsis thaliana
  G2459,YABBY domain coordinates 11-49,100-147
MANSVMATEQLCYIPCNFCNIILAVNVPCSSLFDIVTVRCGHCTNLWSVNMAAALQSLSRPNFQATNYAVPEYGSSSRSHTKIPSRISTRTITEQRIVNRPPEKRQRVPSAYNQFIKEEIQRIKANNPDISHREAFSTAAKNWAHFPHIHFGLMLESNKQAKIA

SEQ ID NO: 1621 - DNA, 849 bp, Arabidopsis thaliana
  G2467,family:HS
atggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattag

SEQ ID NO: 1622 - protein, 282 aa, Arabidopsis thaliana
  G2467,HS domain coordinates 28-119
MDPSSSSRARSMPPPVPMEGLQEAGPSPFLTKTFEMVGDPNTNHIVSWNRGGISFVVWDPHSFSATILPLYFKHNNFSSFVRQLNTYGFRKIEAERWEFMNEGFLMGQRDLLKSIKRRTSSSSPPSLNYSQSQPEAHDPGVELPQLREERHVLMMEISTLRQEEQRARGYVQAMEQRINGAEKKQRHMMSFLRRAVENPSLLQQIFEQKRDREEAAMIDQAGLIKMEEVEHLSELEALALEMQGYGRQRTDGVERELDDGFWEELLMNNENSDEEEANVKQD

SEQ ID NO: 1623 - DNA, 1404 bp, Arabidopsis thaliana
  G2469,family:AKR
atgagcaatactttcgaagaatcactcaaatctatgtcattggattacctaaacctcttaatcaacggtcaagctttctccgatgtcactttcagcgtcgaaggccgtctagtccacgctcaccgttgcatcctcgctgctcgtagcctcttcttccgcaaattcttctgtgaatctgatccttcgcaacccggagctgaacccgctaaccaaaccggatcaggagccagagcagccgcagtaggaggagtcataccggttaactcagtcggttacgaagttttcttacttctacttcaattcttgtacagtggtcaagtctcaattgtaccacataagcacgagccaagatcgaattgtggagatagaggatgctggcacacgcattgcactgcagccgtcgatctctctttagatattttagccgccgctcgctactttggcgtcgagcagctcgcgttgcttactcagaaacatttgacaagtatggtggagaaagcctccattgaagatgtgatgaaagtgctcatagcttcaagaaagcaagacatgcatcaattatggactacttgctcttacttaatcgccaaatccggtcttccacaagagattctagccaaacatctcccaatcgaacttgtagccaagattgaggagctccgtctcaaatcttcaatgcctctccgttcactaatgcctcaccaccatgacctaacctcgactttagacctcgaagaccagaagatcaggaggatgagacgtgcattggactcctctgatgtcgagcttgtgaagctaatggtgatgggagaaggactcaatctagatgagtccctagctttgatttacgcggttgaaaattgtagtagagaggttgtaaaggcacttcttgagcttggagcagctgatgtgaactatcccgcgggtcccacagggaaaaccgctcttcacattgcggctgaaatggtgtctccggacatggtggctgttttactcgaccaccacgccgaccctaacgtccagacagtggatggaatcactcctctcgacatccttcgaaccctaacgtcagattttttgttcaagggggcaattcctggattgactcacattgagcccaataagcttaggctttgtctcgagctggtccagtccgcggcattggttatatcacgcgaagaaggaaacaataacagtaacgataacaacacaatgatctaccctaggatgaaagacgaacacacgagcggaagtagtttggattcaagattggtttatctgaatcttggtgctacaaatcgtgatattggagatgacaatagcaatcaaagggaaggaatgaatctgcatcatcatcatcatgacccatcaacgatgtatcatcaccaccaccaccatttctag

SEQ ID NO: 1624 - protein, 467 aa, Arabidopsis thaliana
  G2469,AKR domain coordinates 27-164,276-340
MSNTFEESLKSMSLDYLNLLINGQAFSDVTFSVEGRLVHAHRCILAARSLFFRKFFCESDPSQPGAEPANQTGSGARAAAVGGVIPVNSVGYEVFLLLLQFLYSGQVSIVPHKHEPRSNCGDRGCWHTHCTAAVDLSLDILAAARYFGVEQLALLTQKHLTSMVEKASIEDVMKVLIASRKQDMHQLWTTCSYLIAKSGLPQEILAKHLPIELVAKIEELRLKSSMPLRSLMPHHHDLTSTLDLEDQKIRRMRRALDSSDVELVKLMVMGEGLNLDESLALIYAVENCSREVVKALLELGAADVNYPAGPTGKTALHIAAEMVSPDMVAVLLDHHADPNVQTVDGITPLDILRTLTSDFLFKGAIPGLTHIEPNKLRLCLELVQSAALVISREEGNNNSNDNNTMIYPRMKDEHTSGSSLDSRLVYLNLGATNRDIGDDNSNQREGMNLHHHHHDPSTMYHHHHHHF

SEQ ID NO: 1625 - DNA, 1662 bp, Arabidopsis thaliana
  G2494,family:BPF-1
atggtgtcacataaagtcttagaatttggagatgatggttacaaattacctgctcaagctcgagctccgagatcactccggaagaagcgcatttacgaaaagaagataccaggagatgataagatgtgcgcgattgacttattggccaccgtagctggaagcttgcttctcgagagcaaaagtccggtaaacgcgtgtctagttgtacaaaatactgtaaagaatgaatacccggctgatgaaaaccccgtaaaggcggttccttattcggaatccccgagcctatttgacaatggcaagtgtggatttagctctgtgataacaaatcctaatcacttgttggtaggtgacaaagtaggaaaggaggtggagggttttagtagtttgggtgtgagtggtgatgtaaagcctgatgttgtagctagtataggtagtaacagtagtaccgaggtgggagcatgtgggaacggtagtcccaacgagtctcgggatgatgtaaatttgtttagtagaaatgatgatgatgaaaacttttcgggttacattcgaactcgtatgactaggcctgtgcctcgtattggagacagaagaattaggaagatattggcatctagacattggaaaggaggttcgaagaacaacacagatgcaaagccatggtattgctcaaagaggagttattacttgcaccatcatcagaggagttatcccatcaagaaaaggaaatactttgacagtgtttacgactcgaactctgatgattaccgtttgcaaggaaagactcataaaggaagcagaacaatatcttccatgaaaagtcgaaatgcgtcctttgtgtcaagggatcatcatgtgaagctgcggatcaagtcttttagggtgcctgagcttttcgtagagattccagaaactgctactgttggctccttgaagcggatggtgatggaagcagtgaccaccatactgggtgatggacttcgagtcgggctgatggttcaaggaaagaaagtccgagatgatggcaaaactcttcttcagactgggatctctgaggagaacaaccacttggattctcttggtttcagccttgaacctagcttagagaccacccctcaaccactgttatccagttatctgtcagatcatgcctgtgatgatgtgacgttatgccacgacaatgcgttggattctagtcatgagccagaaccatccccagctgactcatttgggaaactaggcacaagtgatcattctagagctttgattcctgttgcctcagcagcaatgctggctcctcggcctcctaaccgtaagtttaaaaggactgagcagcagctagctgcacaacgcagaattcgtcgacctttctcagttactgaagtagaagcactggtccaagccgttgagaaactcggaaccggaaggtggagagatgtgaaggttcgtgctttcgaggacgcagaccatcgtacctatgttgatctcaaggataagtggaagacgctggtccacacggcaaggatatctccacaacagcggagaggagagccggtgccacaggaacttctggaccgtgttttgaaggcacacgcttactggtcacaacacctaatgcatcaactgcagactgagccaccatccactcaggtagaggctctctaa

SEQ ID NO: 1626 - protein, 553 aa, Arabidopsis thaliana
  G2494,BPF-1 domain coordinates 285-365,449-535
MVSHKVLEFGDDGYKLPAQARAPRSLRKKRIYEKKIPGDDKMCAIDLLATVAGSLLLESKSPVNACLVVQNTVKNEYPADENPVKAVPYSESPSLFDNGKCGFSSVITNPNHLLVGDKVGKEVEGFSSLGVSGDVKPDVVASIGSNSSTEVGACGNGSPNESRDDVNLFSRNDDDENFSGYIRTRMTRPVPRIGDRRIRKILASRHWKGGSKNNTDAKPWYCSKRSYYLHHHQRSYPIKKRKYFDSVYDSNSDDYRLQGKTHKGSRTISSMKSRNASFVSRDHHVKLRIKSFRVPELFVEIPETATVGSLKRMVMEAVTTILGDGLRVGLMVQGKKVRDDGKTLLQTGISEENNHLDSLGFSLEPSLETTPQPLLSSYLSDHACDDVTLCHDNALDSSHEPEPSPADSFGKLGTSDHSRALIPVASAAMLAPRPPNRKFKRTEQQLAAQRRIRRPFSVTEVEALVQAVEKLGTGRWRDVKVRAFEDADHRTYVDLKDKWKTLVHTARISPQQRRGEPVPQELLDRVLKAHAYWSQHLMHQLQTEPPSTQVEAL

SEQ ID NO: 1627 - DNA, 832 bp, Arabidopsis thaliana
  G2512,family:AP2
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 1628 - protein, 244 aa, Arabidopsis thaliana
  G2512,AP2 domain coordinates 79-147
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 1629 - DNA, 841 bp, Arabidopsis thaliana
  G2513,family:AP2
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 1630 - protein, 209 aa, Arabidopsis thaliana
  G2513,AP2 domain coordinates 27-94
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 1631 - DNA, 690 bp, Arabidopsis thaliana
  G2514,family:AP2
aaaacttcttcatcttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattga

SEQ ID NO: 1632 - protein, 192 aa, Arabidopsis thaliana
  G2514,AP2 domain coordinates 16-82
MNSSMASAGLGSRRKDPVYRGIRCRSGKWVSEIREPRKTTRIWLGTYPMAEMAAAAYDVAAMALKGREAVLNFPGSVGSYPVPESTSAADIRAAAAAAAAMKGCEEGEEEKKAKEKKSSSSKSRARECHVDNDVGSSSWCGTEFMDEEEVLNMPNLLANMAEGMMVAPPSWMGSRPSDDSPENSNDEDLWGY

SEQ ID NO: 1633 - DNA, 975 bp, Arabidopsis thaliana
  G2534,family:NAC
atggataatataatgcaatcgtcaatgccaccgggattccgatttcatccgacagaggaagagcttgtgggttattacctagataggaagatcaattcaatgaagagtgctttagatgtcattgtagagattgatctctacaaaatggagccatgggatatacaagcgaggtgtaaactagggtatgaagagcaaaacgagtggtacttctttagtcataaggacaggaagtaccctaccgggactaggaccaaccgagccactgcggctgggttctggaaagccacgggtagagacaaggcggtactatcaaaaaacagtgtcatcggaatgcggaagacacttgtctactacaagggtcgagctcctaatggaagaaagtccgattggatcatgcacgaataccgtctccaaaactccgagcttgccccggttcaggaggaaggctgggtggtgtgtcgagcatttaggaagccaattccaaaccagaggccattagggtacgagccatggcagaaccagctctaccacgtcgaaagtagtaacaactactcatcttcagtgacaatgaacacgagtcatcatatcggtgcatcttcatcaagtcataaccttaatcaaatgctcatgagcaataaccactacaatcctaataatacatcctcatcgatgcatcaatatggcaacattgagctcccgcagttggacagcccgagcttgtcgcctagtttagggacgaataaagatcagaacgagagtttcgagcaagaagaagagaagagctttaactgtgtggattggagaacactagataccttgcttgagacacaagtcatacatccgcataaccctaatattcttatgttcgaaacgcagtcgtataatccggcgccaagcttcccttccatgcatcaaagctataatgaggtcgaagctaatattcatcattctcttggatgcttccctgactcgtaa

SEQ ID NO: 1634 - protein, 324 aa, Arabidopsis thaliana
  G2534,NAC domain coordinates 10-157
MDNIMQSSMPPGFRFHPTEEELVGYYLDRKINSMKSALDVIVEIDLYKMEPWDIQARCKLGYEEQNEWYFFSHKDRKYPTGTRTNRATAAGFWKATGRDKAVLSKNSVIGMRKTLVYYKGRAPNGRKSDWIMHEYRLQNSELAPVQEEGWVVCRAFRKPIPNQRPLGYEPWQNQLYHVESSNNYSSSVTMNTSHHIGASSSSHNLNQMLMSNNHYNPNNTSSSMHQYGNIELPQLDSPSLSPSLGTNKDQNESFEQEEEKSFNCVDWRTLDTLLETQVIHPHNPNILMFETQSYNPAPSFPSMHQSYNEVEANIHHSLGCFPDS

SEQ ID NO: 1635 - DNA, 876 bp, Arabidopsis thaliana
  G2545,family:HB
atgcaagaagcggcactaggtatgatgggagccaccgtaggcggagacggagacaccgcggtcgtggcggagcagaatagacagttgaaaggtgagatagcgacacatccgatgtatgagcaattattagccgcacacgtggcgtgtttaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaagatcccttatggaaagagtcagacaagaactcaaactagaactcaaacagggttttaaatcgagaatcgaagatgtaagagaagagataatgaggaagagaagggctgggaaattgccaggagacacaactactgtcttgaaaaattggtggcaacaacattgcaaatggccttaccctacggaagatgacaaggcaaaattggtggaggagacaggattgcagttgaagcaaatcaacaattggttcattaaccaacgcaagaggaattggcacaacaactctcactccctcacttccttgaagtccaagcgcaaacactaa

SEQ ID NO: 1636 - protein, 291 aa, Arabidopsis thaliana
  G2545,HB domain coordinates 215-278
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 1637 - DNA, 861 bp, Arabidopsis thaliana
  G2548,family:HB
atgtatgtgtttgatccaacaacagaagctggattgagattagagatggcgtttcctcaacatggttttatgttccaacaacttcatgaagacaacagtcaagatcagctcccttcttgtcctcctcatctcttcaatggaggaggaaactacatgatgaacagatctatgtctttaatgaacgtgcaagaagatcataatcaaaccttggatgaggagaatctatcagacgatggggcacatactatgctgggagagaagaagaagaggctgcaattagagcaagttaaggcattagagaagagctttgagcttggtaacaagctggagccagagaggaagatacaactagctaaagcattagggatgcaaccaagacagatcgcgatttggtttcaaaacaggagagctaggtggaagactagacagctcgagagagattatgattcactcaagaaacagtttgagtctcttaaatccgacaatgcttctctacttgcctataacaagaaactccttgctgaggtaatggctttaaagaacaaagaatgtaatgaaggaaacatagtaaagagagaagcagaagcttcatggagcaacaacggaagcacagagaatagttcagacatcaatctggagatgcctagagagaccattacaacacatgtgaacacgatcaaagacctattcccttcatcgattcgatcatctgcacatgatgatgatcatcatcagaatcatgaaatagttcaagaagaaagcctttgtaacatgtttaatggcattgatgaaacgacgccggctggttactgggcatggtctgacccaaaccacaaccaccaccaccaccagttcaactga

SEQ ID NO: 1638 - protein, 286 aa, Arabidopsis thaliana
  G2548,HB domain coordinates 83-143
MYVFDPTTEAGLRLEMAFPQHGFMFQQLHEDNSQDQLPSCPPHLFNGGGNYMMNRSMSLMNVQEDHNQTLDEENLSDDGAHTMLGEKKKRLQLEQVKALEKSFELGNKLEPERKIQLAKALGMQPRQIAIWFQNRRARWKTRQLERDYDSLKKQFESLKSDNASLLAYNKKLLAEVMALKNKECNEGNIVKREAEASWSNNGSTENSSDINLEMPRETITTHVNTIKDLFPSSIRSSAHDDDHHQNHEIVQEESLCNMFNGIDETTPAGYWAWSDPNHNHHHHQFN

SEQ ID NO: 1639 - DNA, 1547 bp, Arabidopsis thaliana
  G256,family:MYB-(R1)R2R3
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 1640 - protein, 332 aa, Arabidopsis thaliana
  G256,MYB-(R1)R2R3 domain coordinates 14-116
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 1641 - DNA, 2137 bp, Arabidopsis thaliana
  G2572,family:AP2
cttcagcttctttttagccttcattcaaatctcagacacaccagtgtgtatacatgcatttgctctcttgatctccttgaaacttttgttttattccaaaacacatgcaaagtagataaagagatcttcttcttctgataataacctcgtgattatcgttttctcaagtcttcttcttcttcttcgttaccacacaaatgcagaagtactaatatagtgtaacgcttaatcaggctcagcaaagggtttaccaaagaagaagaacaaacaacaaacaagagagagaaaaagtaaaattgtttttataagaaagtttatgatggctccgatgacgaactggttaacgttttctctgtcaccaatggagatgttgaggtcatctgatcagtctcagtttgtctcctatgacgcttcttccgccgcttcctcctctccttatctcctcgataatttctatggttggtcaaaccaaaaacctcaggagtttttcaaagaagaagctcagttagcagcagcagcttcaatggcggattcaacaatcttaacaacattcgtagacccacaatctcatcattctcagaatcacatcccaaagctcgaagattttctcggtgactcttcttctatcgttcgttactccgacaacagtcaaaccgacacacaagactcttccctcactcaaatctacgatccacgtcaccaccataaccaaaccggcttttactccgatcaccacgatttcaaaaccatggccggttttcaatccgctttctctactaactccggttcagaggtcgatgactctgcttctatcggaaggactcatcttgctggagactatttgggacacgtggttgaatcttctggtccggagctagggtttcacggtggatctaccggagctttgtcacttggtgttaacgtcaataacaatactaatcaccggaatgataatgataatcattaccgaggcaataacaatggtgagagaatcaacaacaacaacaacaatgacaacgagaagacagattctgagaaggagaaggctgttgtggctgtggaaacatcagattgttctaataagaagattgctgatacgtttggtcaaaggacttcgatttacagaggtgttactcgacatagatggacgggaagatatgaagcacatctatgggataatagctgtaggagagaaggtcaggccaggaagggacgtcaagtatacttgggtggatatgacaaagaagataaggcagctcgagcttacgatttagcagctctgaaatactggaatgctactgctaccaccaatttccctattacgaattactcgaaagaagtggaggaaatgaagcacatgaccaagcaagagttcattgcctccctcaggaggaagagtagcggtttctctagaggagcttcgatataccgaggtgttacaaggcatcatcaacaaggacgttggcaagcaaggattggccgagttgctgggaacaaagatctttaccttggaacctttgcaacggaagaggaagcagctgaagcgtatgacatagcagcaatcaaattcagaggaataaacgctgtaactaactttgagatgaaccgttacgacgttgaagccatcatgaagagtgcacttcccatcggtggtgcagctaaacgtcttaagctctctttggaagctgctgcttcatcagagcagaaaccaatcctcggtcatcatcaacttcaccatttccagcaacaacaacaacaacaacagcttcagcttcagtcatctcctaatcacagtagcattaacttcgctctctgtcctaattcagcagttcagtctcaacagatcattccttgtggaatcccttttgaagcagctgctctttaccaccaccaccaacaacaacagcaacaccaacagcagcagcagcaacagaacttcttccagcattttccggcgaatgcagcttctgactcgaccgggtctaacaacaactccaacgttcagggaacaatgggacttatggcaccaaatccggctgagttcttcctctggcctaatcagtcttactaaaaccaatcatataagttgattgagtcaagtttttatcgttataagagacacaacttcttgattctg

SEQ ID NO: 1642 - protein, 584 aa, Arabidopsis thaliana
  G2572,AP2 domain coordinates 266-342,368-436
MMAPMTNWLTFSLSPMEMLRSSDQSQFVSYDASSAASSSPYLLDNFYGWSNQKPQEFFKEEAQLAAAASMADSTILTTFVDPQSHHSQNHIPKLEDFLGDSSSIVRYSDNSQTDTQDSSLTQIYDPRHHHNQTGFYSDHHDFKTMAGFQSAFSTNSGSEVDDSASIGRTHLAGDYLGHVVESSGPELGFHGGSTGALSLGVNVNNNTNHRNDNDNHYRGNNNGERINNNNNNDNEKTDSEKEKAVVAVETSDCSNKKIADTFGQRTSIYRGVTRHRWTGRYEAHLWDNSCRREGQARKGRQVYLGGYDKEDKAARAYDLAALKYWNATATTNFPITNYSKEVEEMKHMTKQEFIASLRRKSSGFSRGASIYRGVTRHHQQGRWQARIGRVAGNKDLYLGTFATEEEAAEAYDIAAIKFRGINAVTNFEMNRYDVEAIMKSALPIGGAAKRLKLSLEAAASSEQKPILGHHQLHHFQQQQQQQQLQLQSSPNHSSINFALCPNSAVQSQQIIPCGIPFEAAALYHHHQQQQQHQQQQQQQNFFQHFPANAASDSTGSNNNSNVQGTMGLMAPNPAEFFLWPNQSY

SEQ ID NO: 1643 - DNA, 653 bp, Arabidopsis thaliana
  G2583,family:AP2
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 1644 - protein, 189 aa, Arabidopsis thaliana
  G2583,AP2 domain coordinates 4-71
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 1645 - DNA, 765 bp, Arabidopsis thaliana
  G2587,family:WRKY
atggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcaagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattag

SEQ ID NO: 1646 - protein, 254 aa, Arabidopsis thaliana
  G2587,WRKY domain coordinates 108-165
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 1647 - DNA, 1063 bp, Arabidopsis thaliana
  G2588,family:WRKY
tttcgttttttaaaagtatcctttgtgaagaagaaaatggaagaagttgaagctgcaaacaaagcagcagtggaaagttgtcatggagtattgaatctcttatcacaacaaaccaatgattccaaatcaataatggttgaaacaagagaagctgtttgcaagttcaagagagtctcctctcttttgtctagagggttaggtcaaaggaagataaagaaactcaacaacaacaactacaagtttagctcttctttgttgccacaacacatgtttttggagagtcctgtttgcagtaataatgctataagtggttgtattccaattctagcaccaaagcctcttcagattgtaccagctggtcctcctccattgatgttgtttaaccagaatatgtgtcttgataagtcgtttctcgagctgaagccaccctcttcacgagctgttgatccaaaaccttatcagtttattcatacccatcagcaaggagtgtactcaaggagcaaaagtggtttgaatctaaagtttgatgggtctattggtgctagttgttattcaccaagtatatcaaatgggtcaagatcgtttgtttcatctcttagtatggatggtagtgtgacggattacgatagaaactcttttcatttgattggattacctcaaggttccgatcatatatcgcaacattctaggaggactagttgctctggtagtttaaaatgtggaagtaaaagcaaatgccattgttccaagaaaaggaaattaagggtgaaacgatcgattaaagtaccggcaatcagtaacaagattgcggacatacctcccgatgaatattcatggaggaaatacggacaaaagccgattaagggttctcctcatcctaggggatactataaatgtagcagtgtgcgcggttgtccagcgaggaagcatgttgagcgatgtgtagaagaaacttcgatgcttattgtgacttatgaaggcgagcataaccattcaagaatactctcttctcaatcagctcatacttgattgattgtagtaacggtcttcaattgtatattct

SEQ ID NO: 1648 - protein, 330 aa, Arabidopsis thaliana
  G2588,WRKY domain coordinates NA
MEEVEAANKAAVESCHGVLNLLSQQTNDSKSIMVETREAVCKFKRVSSLLSRGLGQRKIKKLNNNNYKFSSSLLPQHMFLESPVCSNNAISGCIPILAPKPLQIVPAGPPPLMLFNQNMCLDKSFLELKPPSSRAVDPKPYQFIHTHQQGVYSRSKSGLNLKFDGSIGASCYSPSISNGSRSFVSSLSMDGSVTDYDRNSFHLIGLPQGSDHISQHSRRTSCSGSLKCGSKSKCHCSKKRKLRVKRSIKVPAISNKIADIPPDEYSWRKYGQKPIKGSPHPRGYYKCSSVRGCPARKHVERCVEETSMLIVTYEGEHNHSRILSSQSAHT

SEQ ID NO: 1649 - DNA, 591 bp, Arabidopsis thaliana
  G2629,family:bZIP
atgaacacgattccagccgaactcactggatacttccactatctaccaccagataaatataataaccaaacaccaatcatggagtctgagtacttcaacatgccctcttctcctacttcttgttcctccttctaccacctcaatggtctgatcaacaacaacaactactcttcatcatccaatggtcaggatctaatgacgagcaacaactcaacttcagacgaagatcaccaacaaagtatggtcatcgatgagaggaaacaaaggagaatgatctctaacagggaatctgctcgtaggtcaagaatgagaaagcagagacatctcgatgagctttggtctcaagtgataagacttcgcactgataaccactgtcttatggataagctgaaccgcgtatctgaaagccatgagcttgctttaaaggagaacgctaagcttaaagaggaaacttctgatctcagacagctgatctctgagataaagtcacacaacgaagacgacaacagttttttaagagagctcgaagattcgatatcaaactctagatcggattcgaaccaaagcggcagagattttgagttgtgttaa

SEQ ID NO: 1650 - protein, 196 aa, Arabidopsis thaliana
  G2629,bZIP domain coordinates 85-154
MNTIPAELTGYFHYLPPDKYNNQTPIMESEYFNMPSSPTSCSSFYHLNGLINNNNYSSSSNGQDLMTSNNSTSDEDHQQSMVIDERKQRRMISNRESARRSRMRKQRHLDELWSQVIRLRTDNHCLMDKLNRVSESHELALKENAKLKEETSDLRQLISEIKSHNEDDNSFLRELEDSISNSRSDSNQSGRDFELC

SEQ ID NO: 1651 - DNA, 1473 bp, Arabidopsis thaliana
  G2633,family:SCR
atgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatga

SEQ ID NO: 1652 - protein, 490 aa, Arabidopsis thaliana
  G2633,SCR domain coordinates 197-262,325-413,417-489
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 1653 - DNA, 918 bp, Arabidopsis thaliana
  G2635,family:NAC
atgagttcgtctaacggaggtgtaccgcctggttttcggtttcatccaacggacgaagaacttcttcattactacttgaagaagaagatttcttatgaaaagtttgagatggaagtcatcaaagaggttgatttgaacaagattgagccgtgggatttacaagatagatgcaaaataggatcaacgccacaaaatgagtggtatttcttcagccacaaggataggaaatatccgacagggtcaaggacaaaccgtgcaacccactccggtttttggaaggcgacaggacgtgacaaatgcataagaaattcttacaagaagatcggcatgaggaagactcttgtattctacaaaggaagagctcctcatggccaaaagacagattggatcatgcacgagtaccgtatcgaagacactgaagatgacccttgtgaagatggatgggttgtttgtagagtgttcaagaagaaaaatctgttcaaagtagggaatgatgttggctcaaacatcagcaataataggcttgaagctcgtagtttcatccgaagagaaagcccttaccaaggaatctcaatgtttgagcttaacaagcctgaagagattagtgttcatcaatatcctcaaccaccaatgtttcaacctcatcacaagcctctttcaataggctatgactattcattggctcttctaccaagagaaagcgagtaccaacaagcgtgtcagccatcaggggttgaggttggcacgtgcaaggcagtaagtgaatggggaatagtgaattgtaacatggtgagtcatgaggactcgtctagagcgatgaggtttgaagatgacggtaacaacacttcttccacggtccagccaccttctaatctgctttcattgcgcggtgaaaatggatttcttgggttgttttaa

SEQ ID NO: 1654 - protein, 305 aa, Arabidopsis thaliana
  G2635,NAC domain coordinates 8-161
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 1655 - DNA, 522 bp, Arabidopsis thaliana
  G2642,family:SRS
atggatatgaacatggagaagatttttgaggattcagttccttgtagggttcgtgctaaacgtggttgtgctactcatcctcgtagcattgctgaacgggctgcgatgatgatgattcgtagtggtggcagcggaggaagtggtggtgtgagctgtcaagactttgggaatcaagcgaagaaagattgctctcacatgaggtgtagaacttgttgtaagagccgtggcttcgagtgttctactcacgtgagaagcacgtgggttcctgctactaaacgccgtgagagacaacaacaattagctacggttcagcctcaaactcagctgcctcgcggtgagagcgttcctaaacgccaccgtgagaatttaccggcaacttcatcgtctctagtctgcactcgcataccttttcattcaggtatatgtcactgcaatgtgaaatatttatttatgtgtatatatatatgtttattattatatggtcgtgagatatataatgaaatgcaagcagcatttttataa

SEQ ID NO: 1656 - protein, 173 aa, Arabidopsis thaliana
  G2642,SRS domain coordinates 54-97
MDMNMEKIFEDSVPCRVRAKRGCATHPRSIAERAAMMMIRSGGSGGSGGVSCQDFGNQAKKDCSHMRCRTCCKSRGFECSTHVRSTWVPATKRRERQQQLATVQPQTQLPRGESVPKRHRENLPATSSSLVCTRIPFHSGICHCNVKYLFMCIYICLLLYGREIYNEMQAAFL

SEQ ID NO: 1657 - DNA, 610 bp, Arabidopsis thaliana
  G2689,family:MADS
tatagtcaattcatatttttgttttcttccaaaatgaatcccaagaaaaccaaaggaaagcaaatgattaacatcaaaaaaattgaaaaagatgaagacagattggtcacattatctaagcgtcgaaatggaatctacaataagcaatgagctttccattctctgtggtgctgaagttgcgtttctcggatactcttgctcaggaaaaccatacacattcggcagtccgtcttttcaagccgtggcagagcgatttctcaatcgtgaggcctcatcatcgttgcaacgatcggtcatgaatgctcaccaacaagcgaagattcaagagctttgcaaagtatacaatagaatggtggaggaggcaaagacggaagaagccaaagtaaagaaggcagctgcattagcggagacaatgcccgtagatgaggatgcgtggtggaaagtggatccaaaggaggtggaagatcacgaagaggcgaagaagataatggaaaagtgtgaagggctctatgagaaactgtgtaatgaagctgctgcaaggatccaaagaggagatgctgagaataataacaaatgatccattaatgattaagattttaattagtagatc

SEQ ID NO: 1658 - protein, 161 aa, Arabidopsis thaliana
  G2689,MADS domain coordinates 1-43
MKTDWSHYLSVEMESTISNELSILCGAEVAFLGYSCSGKPYTFGSPSFQAVAERFLNREASSSLQRSVMNAHQQAKIQELCKVYNRMVEEAKTEEAKVKKAAALAETMPVDEDAWWKVDPKEVEDHEEAKKIMEKCEGLYEKLCNEAAARIQRGDAENNNK

SEQ ID NO: 1659 - DNA, 1923 bp, Arabidopsis thaliana
  G2698,family:SCR
atgcccttatcctttgaaaggtttcaaggggagggggtgtttggtttatcttcttcttctttctattcagattctcagaaaatctggtccaatcaagacaaaaccgaagcaaaacaagaagatcttggttatgttgtcggtggttttttaccggagccgacgtctgttctcgacgctctaagaagtcctagtcctctcgcttcttattcttctaccaccaccacgctgtcttcctctcacggcggcggtggtaccaccgtcaccaacaccaccgtaaccgccggtgatgataacaataacaataaatgtagtcagatgggtttggatgatcttgacggtgttctctctgcttcttctcctggtcaagagcagagtatcttgagacttatcatggacccgggttctgccttcggtgttttcgacccgggtttcggattcgggtctggttccgggcctgtgtctgctccggtgagtgataattcgaatcttctgtgtaacttcccgtttcaagagattacgaatccagcagaagctttgatcaatccttcaaatcattgcctgttctataatcctccgttatctccaccggctaaacggtttaattccggatctcttcatcaacccgttttccctttatcggatccggatccgggtcacgacccggttcgtcgtcaacatcagtttcagtttccgttttatcacaacaaccagcaacaacaattcccgtcgtcttcttcttccacggcggtggctatggttccggttccgtcgccgggaatggccggcgatgaccagtcagtcatcatcgagcagctgttcaacgcggcggagctaatcggaaccaccggaaacaacaacggcgaccacaccgttctcgcgcaagggatattggcgcggctcaatcaccatctcaacactagtagtaaccacaagtctccgtttcaaagagcagcttctcacatcgctgaagctctcctctcactcatccacaacgaatcatcaccaccgttaatcacgccggagaatctgattctccgaatcgccgcttacagatccttctccgaaacctcgccgtttctccaattcgttaacttcacagcgaatcaatcgattcttgagtcctgcaacgaatcagggtttgatcggatccacattatcgatttcgacgttggatatggaggacaatggtcgtctctaatgcaagaactcgcttccggagttggaggaagaagaagaaacagagcatcgtctctgaaattaacagtctttgctcctccaccttctacagtctccgacgagttcgagcttcgtttcacagaggaaaatctcaaaacattcgccggagaagtcaagattcctttcgaaatcgagttactaagcgtagagcttcttctaaacccagcttattggccactctctctacgttcatcggaaaaagaagcaatcgcagtgaatcttccagtaaactccgtcgcctccggttaccttccgttaatcctccgattccttaaacaactatcaccaaacatcgtcgtttgctcagacagaggatgtgaccgtaacgacgcgccgtttccaaacgcagtgattcattcgcttcaataccacacttctctgcttgagtctcttgatgctaatcagaaccaggacgattcgagtatcgagaggttttgggttcaaccatcgatagagaagctgttgatgaaacgacaccgttggattgaaagatctccaccgtggagaatcttgtttacacaatgtgggttttctccggcgagtttgagtcagatggcggaagctcaggcggagtgtttgttgcagagaaatccggtgagagggtttcacgttgagaaaaggcagtcttcacttgtcatgtgttggcaaaggaaagaacttgttactgtctctgcttggaaatgttag

SEQ ID NO: 1660 - protein, 640 aa, Arabidopsis thaliana
  G2698,SCR domain coordinates 350-417,575-638
MPLSFERFQGEGVFGLSSSSFYSDSQKIWSNQDKTEAKQEDLGYVVGGFLPEPTSVLDALRSPSPLASYSSTTTTLSSSHGGGGTTVTNTTVTAGDDNNNNKCSQMGLDDLDGVLSASSPGQEQSILRLIMDPGSAFGVFDPGFGFGSGSGPVSAPVSDNSNLLCNFPFQEITNPAEALINPSNHCLFYNPPLSPPAKRFNSGSLHQPVFPLSDPDPGHDPVRRQHQFQFPFYHNNQQQQFPSSSSSTAVAMVPVPSPGMAGDDQSVIIEQLFNAAELIGTTGNNNGDHTVLAQGILARLNHHLNTSSNHKSPFQRAASHIAEALLSLIHNESSPPLITPENLILRIAAYRSFSETSPFLQFVNFTANQSILESCNESGFDRIHIIDFDVGYGGQWSSLMQELASGVGGRRRNRASSLKLTVFAPPPSTVSDEFELRFTEENLKTFAGEVKIPFEIELLSVELLLNPAYWPLSLRSSEKEAIAVNLPVNSVASGYLPLILRFLKQLSPNIVVCSDRGCDRNDAPFPNAVIHSLQYHTSLLESLDANQNQDDSSIERFWVQPSIEKLLMKRHRWIERSPPWRILFTQCGFSPASLSQMAEAQAECLLQRNPVRGFHVEKRQSSLVMCWQRKELVTVSAWKC

SEQ ID NO: 1661 - DNA, 866 bp, Arabidopsis thaliana
  G2701,family:MYB-related
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 1662 - protein, 263 aa, Arabidopsis thaliana
  G2701,MYB-related domain coordinates 31-81,127-175
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 1663 - DNA, 888 bp, Arabidopsis thaliana
  G2709,family:MYB-related
atgggagctccaaagctgaagtggacaccagaagaagaaacagctcttaaagctggagtacttaaacatggaactggaaaatggcgtaccattctctcagatcctgtgtatagcacaattctgaagtctcgttctaatgtggatctcaaggacaaatggagaaatataagtgtaacagctttatggggatctaggaagaaggctaagcttgctcttaaaagaactcctttgtcgggtagtaggcaagacgataacgctacagctattaccattgtgtctttagctaatggtgatgtaggaggacaacagattgatgcaccatctcctcctgcaggttcttgtgaacctccaagaccttctacaagtgtggataagattatattggaggctattaccagcttgaagagaccatttggtcctgacggaaagtcgatcttgatgtatatagaggagaatttcaagatgcaaccggatatgaaacggcttgtgacttcaaggctgaagtatttgacaaatgttggaacattagttaagaaaaagcacaaatacaggatttctcagaattatatggctgaaggagaaggacaaaggtctcctcaactcttgttggaaggaaacaaggaaaacactccgaaaccggaggagaatggcgtcaaaaatcttactaaatcccaagtaggtggagaagttatgataatgggtatgacagaaaaagaagctgctgcagcagctgcaagagctgtggcagaagcagaatttgcaatggcagaagctgaagaagcagcaagagaggcagataaagcagaagccgaagctgaagctgcccatatttttgcaaaagcggcgatgaaagctgtgaagtatagaatgcatagccaaactcggtaa

SEQ ID NO: 1664 - protein, 295 aa, Arabidopsis thaliana
  G2709,MYB-related domain coordinates 6-54
MGAPKLKWTPEEETALKAGVLKHGTGKWRTILSDPVYSTILKSRSNVDLKDKWRNISVTALWGSRKKAKLALKRTPLSGSRQDDNATAITIVSLANGDVGGQQIDAPSPPAGSCEPPRPSTSVDKIILEAITSLKRPFGPDGKSILMYIEENFKMQPDMKRLVTSRLKYLTNVGTLVKKKHKYRISQNYMAEGEGQRSPQLLLEGNKENTPKPEENGVKNLTKSQVGGEVMIMGMTEKEAAAAAARAVAEAEFAMAEAEEAAREADKAEAEAEAAHIFAKAAMKAVKYRMHSQTR

SEQ ID NO: 1665 - DNA, 903 bp, Arabidopsis thaliana
  G2717,family:MYB-related
atgggtgctcctaagcagaaatggactcaagaagaagagtcagctttaaagtctggagttataaagcatggacctggtaaatggcgcacaattctcaaagatcctgaatttagcggagtcttgtacctgcgttccaatgttgatcttaaggacaaatggagaaacatgagtgtcatggcaaatggctggggatcgcgcgaaaagtctaggttagctgttaaaaggacgttctcccttcctaaacaggaagagaactcactagccctaaccaattctttgcaaagtgatgaagaaaatgtggatgcgacctctggactccaagtttcttctaatcctcctccaaggagacctaatgtaaggttggatagccttataatggaagcaatagctaccctgaaagaacctggtggctgtaacaaaacaacaattggtgcctacattgaggatcaatatcatgctccaccagacttcaaacgcttgttgtctaccaagctaaagtacttgacatcttgcgggaaacttgtgaaggttaaacgtaagtacagaattccaaactccactcccttgtcttcccacaggagaaaaggtctgggggtgtttggaggaaaacagaggacttcttctttgccttcacctaaaacagacatagatgaagtgaattttcagacaaggtcacagattgatacagagatagccagaatgaagagtatgaacgtacatgaggcggcagcagttgcagcacaggcagtagcagaggcagaagctgccatggcagaggctgaggaagctgcaaaggaagcggaggcagcagaagccgaagcagaagcagctcaagctttcgctgaggaagcttcaaagacattgaaaggaagaaacatctgcaaaatgatgatccgtgcctga

SEQ ID NO: 1666 - protein, 300 aa, Arabidopsis thaliana
  G2717,MYB-related domain coordinates 6-54
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEAAQAFAEEASKTLKGRNICKMMIRA

SEQ ID NO: 1667 - DNA, 252 bp, Arabidopsis thaliana
  G2718,family:MYB-related
atgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttga

SEQ ID NO: 1668 - protein, 83 aa, Arabidopsis thaliana
  G2718,MYB-related domain coordinates 32-76
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 1669 - DNA, 1644 bp, Arabidopsis thaliana
  G2738,family:SCR
atgaagagaggatacggagaaacatgggatccgccaccaaaaccactaccagcttctcgttccggagaaggtccttcaatggcggataagaagaaggctgatgatgacaacaacaacagcaacatggatgatgagcttcttgctgttcttggctacaaggttcgatcttctgagatggctgaagtagcacagaagcttgaacaacttgagatggtcttgtctaatgatgatgttggttctactgtcttaaacgactctgttcattataacccatctgatctctctaactgggtcgagagcatgctttctgagctgaacaacccggcttcttcggatcttgacacgacccgaagttgtgtggatagatccgaatacgatctcagagcaattccgggtctttctgcgtttccaaaggaagaggaagtctttgacgaggaagctagcagcaagaggatccgactcggatcgtggtgcgaatcgtcggacgagtcaactcggtccgtggtgctcgttgactctcaggagaccggagttagacttgtccacgcactagtggcgtgcgctgaggcgattcaccaggagaatctcaacttagctgacgcgctggtgaaacgcgtgggaacactcgcgggttctcaagctggagctatgggaaaagtcgctacgtattttgctcaagccttggctcgtcgtatttaccgtgattacacggcggagacggacgtttgcgcggcggtgaacccatctttcgaagaggttttggagatgcacttttacgagtcttgcccttacctgaagttcgctcatttcacggcgaaccaagcgattctagaagctgttacgacggcgcgtagagttcacgtcattgatttagggcttaatcaagggatgcaatggcctgctttaatgcaagctttagctctccgacccggtggacctccgtcgtttcgtctcaccggaatcggaccaccgcagacggagaattcagattcgcttcaacagttaggttggaaattagctcaattcgctcagaacatgggcgttgaattcgaattcaaaggcttagccgctgagagtttatcggatcttgaacccgaaatgttcgaaacccgacccgaatctgaaaccttagtggttaattcggtatttgagctccaccggttattagcccgatccggttcaatcgaaaagcttctcaatacggttaaagctattaaaccgagtatcgtaacggtggttgagcaagaagcgaaccacaacggaatcgtcttcctcgataggttcaacgaagcgcttcattactactcgagcttgtttgactcgctcgaagacagttatagtttaccgagtcaagaccgagttatgtcagaagtgtacttagggagacagatactcaacgttgttgcggcggaagggtccgatcgggtcgagcggcacgagacggctgcacagtggaggattcggatgaaatccgctgggtttgacccgattcatctcggatctagcgcgtttaaacaagcgagtatgcttttatcgctttacgctaccggagatggatacagagttgaagaaaatgacggatgtttaatgatagggtggcagacgcgaccactcatcacaacctcggcgtggaaactcgcctga

SEQ ID NO: 1670 - protein, 547 aa, Arabidopsis thaliana
  G2738,SCR domain coordinates 255-320,379-466,470-544
MKRGYGETWDPPPKPLPASRSGEGPSMADKKKADDDNNNSNMDDELLAVLGYKVRSSEMAEVAQKLEQLEMVLSNDDVGSTVLNDSVHYNPSDLSNWVESMLSELNNPASSDLDTTRSCVDRSEYDLRAIPGLSAFPKEEEVFDEEASSKRIRLGSWCESSDESTRSVVLVDSQETGVRLVHALVACAEAIHQENLNLADALVKRVGTLAGSQAGAMGKVATYFAQALARRIYRDYTAETDVCAAVNPSFEEVLEMHFYESCPYLKFAHFTANQAILEAVTTARRVHVIDLGLNQGMQWPALMQALALRPGGPPSFRLTGIGPPQTENSDSLQQLGWKLAQFAQNMGVEFEFKGLAAESLSDLEPEMFETRPESETLVVNSVFELHRLLARSGSIEKLLNTVKAIKPSIVTVVEQEANHNGIVFLDRFNEALHYYSSLFDSLEDSYSLPSQDRVMSEVYLGRQILNVVAAEGSDRVERHETAAQWRIRMKSAGFDPIHLGSSAFKQASMLLSLYATGDGYRVEENDGCLMIGWQTRPLITTSAWKLA

SEQ ID NO: 1671 - DNA, 1456 bp, Arabidopsis thaliana
  G2741,family:GARP
gaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggtgagcttgttattgctcgtggaactgataattattgtcaagtttctgtttttttaagtacagtacagttataattcttactcgatttgatcgaaattttcatcaagtttctgtcttttactataaatggtatacaataaagtcttaataatcacttgtgaggtgagtgccctcagatttatttgtctgcagacttcttaaagtggtaatcaagagagtgaattgtttatttctgtgagagatggcgtcagacacaaactttattttaaaaatttataaaccaatcaaatgtttca

SEQ ID NO: 1672 - protein, 323 aa, Arabidopsis thaliana
  G2741,GARP domain coordinates 149-197
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 1673 - DNA, 795 bp, Arabidopsis thaliana
  G2767,family:HLH/MYC
atgattatccctgaaactgacagtttcttcttccaagagcaaccgcaacatcagccattgtatcccgacgaagctctttcaccgtctctcttcgggtttgatcactatgatcatttctacgagtcgtttcttccatctcaagaaatcttccttcctagccctaagacccgagtcttcaacgagtcacaggaattagattccttccacacgccaaaacaccagaaactcattgactccagcttccatttcaacagtcacgaccctttttcccctagccctgaatctaattacctcttggattcttacatcacagaagcttccaacatttccaagtttcaagctcctgatttctcatcgacgttcaaggttgggtggactgaacaaggcgacaccaagaagcgagagctatctgctcagagcatcgcagcacgaaagaggagaagaagaatcacagagaagactcaagagctgggaaaactaatccctggaagccagaaacacaacactgccgaaatgttcaatgccgcagctaaatatgtcaagttcttgcaggctcaaattgagattctccaactgaagcagaccaaaatgcagactctggatagttcaaaggtgggaagagaaatgcagtttttgcttggttctcaagaaatccaggagaagctatctacagaagaagtgtgtgtggttccaagggaaatggttcaagtcctaaaagccgaagaatgcatcttgacaaaccctaagatttctcgagacattaacaaattgttgtcaacaaatctgatgaattag

SEQ ID NO: 1674 - protein, 264 aa, Arabidopsis thaliana
  G2767,HLH/MYC domain coordinates 131-188
MIIPETDSFFFQEQPQHQPLYPDEALSPSLFGFDHYDHFYESFLPSQEIFLPSPKTRVFNESQELDSFHTPKHQKLIDSSFHFNSHDPFSPSPESNYLLDSYITEASNISKFQAPDFSSTFKVGWTEQGDTKKRELSAQSIAARKRRRRITEKTQELGKLIPGSQKHNTAEMFNAAAKYVKFLQAQIEILQLKQTKMQTLDSSKVGREMQFLLGSQEIQEKLSTEEVCVVPREMVQVLKAEECILTNPKISRDINKLLSTNLMN

SEQ ID NO: 1675 - DNA, 1436 bp, Arabidopsis thaliana
  G2781,family:DBP
acgttctctctaacacacacacacactctctctctctttcattagataatggatcaaaaaagtaaaacgattggagaacaatggtggaggtcaaatccaacgtttaaaccgcctgaaacgccattagattctatggagtttttgtcacgtacttggagtgcttccgctactgaagtttcaagagctgtcgtcgcgtctccaccgacttctcaaccgccgcaaatgcgtttctcggagatccaaaacggttcttctgacgtcactttggtgccggaagatgaagaaaacggcatcgttcttggaaatactttttcttttgcttcttcagaaacttctttaatggtcatggaacgtatcatggctcagtcaccggagatttcatcgccacgaacatcagggagactttctcatagctcattcaccgacagtcctccgatctctccctccgacatcgacgactttaagcaattctaccgtgtgagcccttcctttaacggccacatacgtggttcatcagccattcccggcaccgccggagggtctaaaactgttggtcgttggctaaaggaccggcgagagaagaagagagaagagacgcgtgcacaaaatgcacagcttcacgcggctgtatctgtagctggagtggctgccgcggtggctgctatcgctgcagccactgcctctcagtcgagttctggaactgacgagcaagtggccaaaaatgactccgcggtggcttctgccgcgactttggtggcggcgaagtgtgtggaagctgcagagattatgggagctgatcgtgagcacttggcctccgttgttagttctgcggttaacgttcgttctgccggagatatcatgactttgaccgccgctgctgccacagctttgagaggagctgcacaattaaaggcaagagcattgaaggaggtatggaacattgcggctgtgattcctgtagataagggtacaccaaaaggcggtggtggtggttatagaggtggcgagttagcccctgtagataattttcttgggatttgcagtaaagaattgctagctaaaggttgcgaattgcttaaacgcacccgcaaaggtgatcttcattggaaagttgtttcgatctacattaatagaacaaagcaggtaatattgaagactaagagcaaacatgttgctgggaccatcacaaagaagaaaaagaatgtggtggtgggattggttaagggattaccggcgtggcctggccgggaaatgctcgagggtggagagaatttgaggtatttcgggctgaagacggtggagaaaagagtgattgaattcgagtgcaaaagccaaagggaatatgatctttggacacaaggtgtttccatgcttctttccattgcttctgataggaaacataaatgttgaattaaggtatagtcttgggtaaagtc

SEQ ID NO: 1676 - protein, 453 aa, Arabidopsis thaliana
  G2781,DBP domain coordinates 228-290
MDQKSKTIGEQWWRSNPTFKPPETPLDSMEFLSRTWSASATEVSRAVVASPPTSQPPQMRFSEIQNGSSDVTLVPEDEENGIVLGNTFSFASSETSLMVMERIMAQSPEISSPRTSGRLSHSSFTDSPPISPSDIDDFKQFYRVSPSFNGHIRGSSAIPGTAGGSKTVGRWLKDRREKKREETRAQNAQLHAAVSVAGVAAAVAAIAAATASQSSSGTDEQVAKNDSAVASAATLVAAKCVEAAEIMGADREHLASVVSSAVNVRSAGDIMTLTAAAATALRGAAQLKARALKEVWNIAAVIPVDKGTPKGGGGGYRGGELAPVDNFLGICSKELLAKGCELLKRTRKGDLHWKVVSIYINRTKQVILKTKSKHVAGTITKKKKNVVVGLVKGLPAWPGREMLEGGENLRYFGLKTVEKRVIEFECKSQREYDLWTQGVSMLLSIASDRKHKC

SEQ ID NO: 1677 - DNA, 2469 bp, Arabidopsis thaliana
  G2817,family:SWI/SNF
atggagcttcggtcccgcaataaggcgattcgtccatcgactgaagttgtggatctcgaggaaggaactggtatcaaccctgatgaagaaccttatgctatatcttcagatgacgattcaatcggctctgaatttcaaggtgacgaggaggaggaggaggagttagaggaggttgttgctaatgatgatttaccaaatcctgtacctgttttggcaattgtaaacctaccaagagcaagcaagaaaaggaaaaaacctgatgcacgcaaagagaaagtagtgctattgtgggagacttgggaaaaagagcagaatagctggattgatgaacatatgtcagaggatgttgatttagatcagcacaatgctgtgattgctgaaactgctgagccgccttcagatttgattatgccgctattaaggtaccaaaaggaatttttggcctgggcaacaaaacaggaacaatctgttgcaggagggattctcgcggatgagatgggaatgggaaaaacaatacaagccatctctcttgttcttgccagacgagaagttgacagggcacagtttggggaagctgcgggttgtactctggttctttgtcctcttgttgctgtttctcagtggttaaatgagattgctcggtttacatccccgggaagcactaaggtccttgtataccatggggcaaagagagcgaagaatattaaagagtttatgaactacgactttgttttgacaacatattccactgttgagagtgaatataggagaaacataatgccgtcgaaggtgcaatgtgcatattgcagcaagtcattttacccgaagaagcttgtgatccacctgcgatatttttgtggaccttcggctgtcaaaacggcaaaacaatctaagcagaaaaggaagaagacttcagattcatcctcacagcaaggcaaggaggctgatgcaggagaggataagaaattaaagaaatctaagaagaagaccaaacaaacagtagaaaaagatcagttaggttcagatgacaaagagaagtctcttttgcactctgttaagtggaatcggatcatcttggatgaggctcattacatcaaagaaagacgtagcaatactgcaagagctgtttttgctttggaggctacctatagatgggctttgagtggcactcctctccaaaatcgtgttggagagctttactcactgatccgcttcttgcaaattcgcccatactcgtattacttttgcaaggattgtgactgtagaattcttgattacttttgtttaatagttaataacaatttatgcggttctgttttctctggtggtgtttgcagtgctcatcaaagctgccctcactgtcctcataatgcagttcgacatttctgttggtggaacaagtatgtggccaagccaataacagtatatggaagctttggactgggaaaaagagccatgatattgcttaaacacaaagttctgaaggacatccttttaagacgtactaaattgggccgggcagctgatcttgctcttcctcctagaattatcactttgaggcgggatacactagatgtaaaggagtttgattactatgaatcactatacaaaaacagccaggcggaatttaatacgtatattgaggctgggacattaatgaataactatgcacatatatttgatcttctcacccgcctgagacaggtgagtggcatctacagtttttttggttcaactaaccagccaatgcacttttttgacgatatagatatattggccgttgatcatccataccttgtggtgtattccaattctagtggcgctaatgctaacttggttgatgagaacaaaagtgagcaagaatgtggtctctgccacgatccggccgaggactacgttgtaataactgtatcttctggaaacagctgctttcatttgacactgtttaagaatcgtcagattactattgtgacttcttgtgcacatgtgttctgtaaagcttgtttgattggtttctccgcgtccctgggaaaagtcacctgcccgacatgctcgaaactactgactgtggattggactaccaaagctgacacagagcataaggcgagcaagacaacacttaaaggatttagagcctcaagcattttaaatcgtataaagcttgatgattttcagacaagtacaaagattgaggctttgagagaagaaattaggttcatggttgaaagagatgggtctgccaaagcaatagttttcagccagttcacatcatttttggaccttataaattatacccttgggaagtgtggggttagttgtgttcaactggtgggaagcatgaccatggcagctagagatactgccatcaacaaattcaaagaagacccagattgcagagttttcttaatgagcttgaaagccggaggggttgctcttaatttaactgttgcttcacatgtaagtgtttag

SEQ ID NO: 1678 - protein, 822 aa, Arabidopsis thaliana
  G2817,SWI/SNF domain coordinates 135-430,579-618,694-777
MELRSRNKAIRPSTEVVDLEEGTGINPDEEPYAISSDDDSIGSEFQGDEEEEEELEEVVANDDLPNPVPVLAIVNLPRASKKRKKPDARKEKVVLLWETWEKEQNSWIDEHMSEDVDLDQHNAVIAETAEPPSDLIMPLLRYQKEFLAWATKQEQSVAGGILADEMGMGKTIQAISLVLARREVDRAQFGEAAGCTLVLCPLVAVSQWLNEIARFTSPGSTKVLVYHGAKRAKNIKEFMNYDFVLTTYSTVESEYRRNIMPSKVQCAYCSKSFYPKKLVIHLRYFCGPSAVKTAKQSKQKRKKTSDSSSQQGKEADAGEDKKLKKSKKKTKQTVEKDQLGSDDKEKSLLHSVKWNRIILDEAHYIKERRSNTARAVFALEATYRWALSGTPLQNRVGELYSLIRFLQIRPYSYYFCKDCDCRILDYFCLIVNNNLCGSVFSGGVCSAHQSCPHCPHNAVRHFCWWNKYVAKPITVYGSFGLGKRAMILLKHKVLKDILLRRTKLGRAADLALPPRIITLRRDTLDVKEFDYYESLYKNSQAEFNTYIEAGTLMNNYAHIFDLLTRLRQVSGIYSFFGSTNQPMHFFDDIDILAVDHPYLVVYSNSSGANANLVDENKSEQECGLCHDPAEDYVVITVSSGNSCFHLTLFKNRQITIVTSCAHVFCKACLIGFSASLGKVTCPTCSKLLTVDWTTKADTEHKASKTTLKGFRASSILNRIKLDDFQTSTKIEALREEIRFMVERDGSAKAIVFSQFTSFLDLINYTLGKCGVSCVQLVGSMTMAARDTAINKFKEDPDCRVFLMSLKAGGVALNLTVASHVSV

SEQ ID NO: 1679 - DNA, 710 bp, Arabidopsis thaliana
  G2827,family:Z-C2H2
ctcaatcatcttctaatcaaagatcaccaccatatggctctcgacactctcaattctcccacctccaccaccacaaccaccgctcctcctcctttcctccgttgcctcgacgaaaccgagcccgaaaacctcgaatcatggaccaaaagaaaacgtacaaaacgtcaccgtatagatcaaccaaaccctcctccttctgaagaagagtatctcgctctttgcctccttatgctcgctcgtggctcctccgatcatcactctccaccgtcggatcatcactctctttctccactgtccgatcatcagaaagattacaagtgttccgtctgtggcaaatctttcccgtcttaccaagcgttaggtggacacaaaacaagtcaccggaaaccggttagtgtcgatgttaataatagtaacggaaccgttactaataacggaaatattagtaacggtttagttggtcaaagtgggaagactcataactgctctatatgttttaagtcgtttccctctggtcaagcattgggtggtcacaaacgttgtcactatgatggtggtaacggtaacagtaacggtgacaatagccacaagtttgacctaaatttaccggctgatcaagttagtgatgagacaattggaaaaagtcaactctccggtgaagaaacaaagtcggtgttgtgaagaaacaaagtcggtgttgtgaggaataa

SEQ ID NO: 1680 - protein, 215 aa, Arabidopsis thaliana
  G2827,Z-C2H2 domain coordinates 96-116,151-171
MALDTLNSPTSTTTTTAPPPFLRCLDETEPENLESWTKRKRTKRHRIDQPNPPPSEEEYLALCLLMLARGSSDHHSPPSDHHSLSPLSDHQKDYKCSVCGKSFPSYQALGGHKTSHRKPVSVDVNNSNGTVTNNGNISNGLVGQSGKTHNCSICFKSFPSGQALGGHKRCHYDGGNGNSNGDNSHKFDLNLPADQVSDETIGKSQLSGEETKSVL

SEQ ID NO: 1681 - DNA, 1986 bp, Arabidopsis thaliana
  G2834,family:Z-C2H2
ccattggtgctctccaagttccatctcaagcttttcttcttgtgggtgattcaatctctctctttctattttttttttcatttctgttgatttagtgatctttgatttgtgaaactttgtttttatcgtgtttgtttttgatttagggttttattttgttgtcggcgagttttgatttgatgattttgatgatttttttttgtttgaccgtttggtttttggatcttaagagttatgtgtgaagatttttttttgtttgtttgggtgaagaatttgtgttgatttcgataattttgagtttgattttgaatcttagtaatgaaatttgattctgtgaagtgtgtatgatgaactttgagctggtcctaattctgattctgataaagatttgatttttatggtttcttttgtaggttttgttgttctcttaattgaaaaacaagatcttgaactaaaaaatggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaaggcattgccatatatatgataagttatg

SEQ ID NO: 1682 - protein, 499 aa, Arabidopsis thaliana
  G2834,Z-C2H2 domain coordinates 246-266,335-356
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 1683 - DNA, 495 bp, Arabidopsis thaliana
  G2839,family:Z-C2H2
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 1684 - protein, 164 aa, Arabidopsis thaliana
  G2839,Z-C2H2 domain coordinates 34-60,85-113
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 1685 - DNA, 1493 bp, Arabidopsis thaliana
  G2853,family:ACBF-like
actctcaaaacacaactctcaaaacttcccctgtttggtccgaaaccgaaactactaaccctaatctctcacatcacataaacaatcacttcacatagccgcaaaatttaatggcagacgtcaaggttcaatccgaatccgaatcctcggattctcatcccttggtcgactatcaatcacttccaccttatcctccgccgcatccaccggttgaagtagaggagaatcaaccaaaaacatctccgactccgccgccgccacactggatgcgttatccaccggtgttaatgcctcagatgatgtacgcgccgccgccaccgatgccgttctcaccttatcatcaatatccgaatcaccaccactttcaccatcaatctcgtggtaataagcatcaaaacgcttttaatggtgagaataaaactatttgggttggtgatttgcaaaactggatggatgaggcttatcttaattctgcttttacttccgccgaagagagagagattgtttcgctgaaggtgattcgtaataagcacaatggttcatcggaaggatatggatttgtggagtttgagtcccatgatgtagctgataaggttttgcaggagtttaacggggcgcctatgccaaatactgaccaaccttttcgtttgaactgggctagttttagcaccggtgagaagcggttagagaacaatggacctgatctctctatatttgttggggatttggcgccagatgtttcggatgctttgttgcacgagaccttctctgagaagtatccgtcggttaaagctgccaaagttgtccttgatgctaatactggtagatcaaaggggtatgggtttgtgaggtttggagatgagaatgaaaggaccaaagcaatgactgagatgaatggtgttaaatgctctagtagagctatgcgtatcggtcctgctaccccaaggaaaactaatggttatcaacaacaaggtggatacatgccgagtggtgcctttacgcgttctgaaggggacacaatcaacacaacaatatttgttggagggcttgactctagtgtcactgatgaagacttaaagcaacctttctctgaattcggggaaatagtgtctgtcaagattcctgttggtaaaggatgcggatttgttcagtttgttaacagaccaaatgcagaggaggctttggaaaaactcaatgggactgtaattggcaaacaaacagtccggctttcttggggccgtaatccagccaataagcagcctagagataagtatggaaaccaatgggttgatccgtactatggaggacagttttacaatgggtatggatacatggtacctcaacctgacccgagaatgtatcctgctgcaccttactatccaatgtacggtggtcatcagcaacaagttagctgaggaaactaaaagcttaatctgagcatctatctataggacaacaaaaactcactcaggttaggtgatgttaggaggtat

SEQ ID NO: 1686 - protein, 434 aa, Arabidopsis thaliana
  G2853,ACBF-like domain coordinates 110-290
MADVKVQSESESSDSHPLVDYQSLPPYPPPHPPVEVEENQPKTSPTPPPPHWMRYPPVLMPQMMYAPPPPMPFSPYHQYPNHHHFHHQSRGNKHQNAFNGENKTIWVGDLQNWMDEAYLNSAFTSAEEREIVSLKVIRNKHNGSSEGYGFVEFESHDVADKVLQEFNGAPMPNTDQPFRLNWASFSTGEKRLENNGPDLSIFVGDLAPDVSDALLHETFSEKYPSVKAAKVVLDANTGRSKGYGFVRFGDENERTKAMTEMNGVKCSSRAMRIGPATPRKTNGYQQQGGYMPSGAFTRSEGDTINTTIFVGGLDSSVTDEDLKQPFSEFGEIVSVKIPVGKGCGFVQFVNRPNAEEALEKLNGTVIGKQTVRLSWGRNPANKQPRDKYGNQWVDPYYGGQFYNGYGYMVPQPDPRMYPAAPYYPMYGGHQQQVS

SEQ ID NO: 1687 - DNA, 943 bp, Arabidopsis thaliana
  G2859,family:HLH/MYC
actttctattttcaccaattttcaaaaaaaaaataaaaattgaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaataattcttcaaggagagggaagaggtcgaagaatagagaagaagagaaagagagagaagttgttcatgttagagctagaagaggccaagccactgatagccacagcatagcagaacgggttcgacgagggaaaataaacgagagattgaaatgcttgcaagatatagtccccggatgttataagacaatgggaatggctactatgcttgatgagataattaattacgtccagtccttacaaaatcaagtcgagtttttatctatgaagcttacagcagcaagttcgtattatgactttaactcggagactgatgctgtggaatccatgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgtaaaaa

SEQ ID NO: 1688 - protein, 261 aa, Arabidopsis thaliana
  G2859,HLH/MYC domain coordinates 150-208
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 1689 - DNA, 519 bp, Arabidopsis thaliana
  G2866,family:IAA
atgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgggctgaagaagaagatatgtgtagtgagaagagtcacgtgctaacgtacgcagacaaagaaggtgactggatgatggttggagatgttccttgggagatgttcttgtctagcgtgagaagactaaagatctcaagagcttatcactactga

SEQ ID NO: 1690 - protein, 172 aa, Arabidopsis thaliana
  G2866,IAA domain coordinates 84-100,139-168
MGRGRSSSSSSIESSCKSNPFGVSSSNTRNLSTDLRLGLSFGSSSGQYYNGGDNHEYDGVGAAEEMMIMEEEEQNECNSVGSFYVKVNMEGVPIGRKIDLLSLNGYHDLITTLDYMFNASILWAEEEDMCSEKSHVLTYADKEGDWMMVGDVPWEMFLSSVRRLKISRAYHY

SEQ ID NO: 1691 - DNA, 2304 bp, Arabidopsis thaliana
  G2869,family:ARF
atggaaagtggcaacgttgtgaatacacaacctgaattatcaggcataattgatggatccaagagttatatgtacgagcagttatggaaactctgtgcgggacctttgtgtgatattccaaaacttggagaaaaggtttattactttcctcaaggccatatagagcttgtgagttctctctctctatattctttctctcttctttctctctctctctctctctctctctctctctctctctctctctctctctctctctctcctttctctctcttctctctcttctctctctcgcctctttctctctctctctctctctctctccttctctctcatgttgaggcatctacaagagaagagttgaatgagttacaaccaatttgtgattttccttctaagcttcaatgtcgtgttattgctattcaacttaaggtggaaaacaatagtgatgagacttatgctgagatcactttgatgccagatacaactcaagttgtaatccctactcagaatcaaaatcaatttaggccattagttaattcctttacgaaggttttaacggcctcagatacaagcgttcatggtggattctctgttccgaaaaaacatgccattgaatgtctccctccgctggatatgtcacagcctctaccgacacaagaaattcttgctatagatcttcatggtaatcaatggagattcagacacatctatagaggtacagcgcaaagacatttgttaacaattggttggaatgcattcacaacatcaaaaaaattggttgaaggagatgttattgtattcgttaggggagagactggagagttacgagttggtatcagacgagcaggacatcaacaagggaatataccttcatcaatagtatcaatagaaagtatgagacatgggataattgcttctgcaaagcatgcttttgataaccaatgtatgttcattgtggtttacaagccaaggtcaagtcaatttattgtcagttacgacaaattcttagacgttgtgaacaataagttcaatgtcggttcaagatttacaatgcggtttgagggtgatgatttctctgaaagaagatcttttgggacaattattggagttagtgatttctctcctcattggaagtgttcagagtggcgcagcttagaagtgcagtgggatgaatttgcatcatttccgagaccaaaccaagtttcaccatgggacatcgaacatttaacgccttggtcaaatgtttccaggtcatcttttctcaagaacaagcgttcacgagaagttaatgaaatcggttcttcctcatcacatctcttgcctcctacattgacacaaggacaagaaattggacaacaaagcatggccaccccgatgaatatttctcttcgttatcgtgatattactgaagatgctatgactccttctagattgctaatgagctaccctgtccaaccaatggccaaactaaattacaataatgtggttacaccaatagaagaaaatataacaaccaatgcagtcgctagttttaggttgtttggagtctctctggccactccttcggtgatcaaagatcccgttgaacaaattggcttggagatttctagacttactcaggaaaaaaagtttggtcaaagccaaattttgagatcaccaacagagatccaaagcaagcagttcagttctaccagaacttgtaccaaagttcaaatgcaaggtgtaacaataggaagagctgtggatttaagtgttcttaatggatatgatcagttaatactagaattggagaagctcttcgatctcaaaggccaattgcaagctcgcaaccaatgggaaatagctttcacaaataatgaagaggataagatgcttgttggagaagatccatggcctgaattctgcaacatgcgtgggtacgtcgcctcaaactccaaggatgatcctgcaaaggttgctgctagcttcacctcccaggtcgtcatcatgaaccaccttggtcagattaaaaatggttacaccccagttcttgattgccacacctctcacattgcagtcaagttctctgagatcttgaccaagattgactggcgtactggtcatgagattgagaaggagccaaagtttttaaagaacagtgaggccgctattattaatatgactcccaccaagcctatggtggttgaggcttactctgcgtacccacccctgggacgttttgctattagggacatgaggcaaaccgttggtgttggagttatcaagagtgttgtcaagaaggacccaagtggagccaaatga

SEQ ID NO: 1692 - protein, 767 aa, Arabidopsis thaliana
  G2869,ARF domain coordinates 26-409
MESGNVVNTQPELSGIIDGSKSYMYEQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEHLTPWSNVSRSSFLKNKRSREVNEIGSSSSHLLPPTLTQGQEIGQQSMATPMNISLRYRDITEDAMTPSRLLMSYPVQPMAKLNYNNVVTPIEENITTNAVASFRLFGVSLATPSVIKDPVEQIGLEISRLTQEKKFGQSQILRSPTEIQSKQFSSTRTCTKVQMQGVTIGRAVDLSVLNGYDQLILELEKLFDLKGQLQARNQWEIAFTNNEEDKMLVGEDPWPEFCNMRGYVASNSKDDPAKVAASFTSQVVIMNHLGQIKNGYTPVLDCHTSHIAVKFSEILTKIDWRTGHEIEKEPKFLKNSEAAIINMTPTKPMVVEAYSAYPPLGRFAIRDMRQTVGVGVIKSVVKKDPSGAK

SEQ ID NO: 1693 - DNA, 1713 bp, Arabidopsis thaliana
  G2870,family:ARF
atggaaactggcaacgttgtgaatgcacaacctgaattatcaggcataattgatagatccaagagctatatgtacgagcagttatggaaactctgtgcgggacctttgtgtgatattccaaaacttggagaaaaggtttattactttcctcaaggcaatatagagcttgttgaggcatctacaagagaagagttgaatgagttacaaccaatttgtgatcttccttctaagcttcaatgtcgtgttattgcaattcatcttaaggtggaaaacaatagtgatgagacttatgctaagatcactttgatgccagatacaactcaagttgtaatccctactcagaatgaaaatcaatttaggccattagttaattcctttacaaaggttttaactgcctctgatataagtgctaatggtgtattttctgttccgaaaaaacatgccattgaatgtctccctcctctggatatgtctcagcctctaccggcacaagaacttcttgctatagatctccatggtaatcaatggagcttcagacacagctatagaggtacaccgcaaagacatttattaacaactggttggaatgaatttacaacatcaaaaaaattggttaaaggagatgttattgtattcgttaggggagagactggagagttacgagttggtatcagacgagcaagacatcaacaagggaatataccttcatcaatagtatcaatagattgtatgagacatggggtaattgcttccgcaaagcatgcttttgataaccaatgtatgttcattgtggtttacaagccaaggtcaagtcaatttattgtcagttacgacaaattcttagacgctgtgaacaataagttcaatgtcggttcaagatttacaatgcggtttgagggtgatgatttatctgaaagaagatattttgggacaattattggagttagtaatttctctcctcattggaagtgttcagactggcgcagcttagaagtgcagtgggatgaatttgcatcatttttgagacctaataaagtgtcaccctgggagatcgaacatttaatgcctgcgttaaatgttccgcgatcatcttttctcaagaacaagcgtttacgagaagttaatgaattcgaagatgctatgaatccttctagattgctaatgagctaccctgtccaaccaatgcccaaacgaaattacaataaccaaatggttacacaaatagaagaaaatataacaaccaaggcaggcactaattttaggttgtttggagtctctctggccactcctccggtgatcaaagatcccattgaacaaattggctcggatatttcgaaacttactgaaggaaaaaagtttggtcaaagccaaactttgagatcaccaacaaaaatccaaagcaagcagttcagttctactagaacttgtacgaaagtaagtataagatcaatatattcttattccttatatatgaaactttttctcattatactcacctcacacaattttgatatggaacaggttcaaatgcaaggtgtaacaataggaagagctgtggatttaagtgttcttaatggatatgatcagctaatactagaattggagaagctcttcgatctcaaaggccaattacaaactcgcaaccaatggaaaataattttcacaggtagtgacgaggatgagatgcttgttggagacgatccatggccgtga

SEQ ID NO: 1694 - protein, 570 aa, Arabidopsis thaliana
  G2870,ARF domain coordinates 26-353
METGNVVNAQPELSGIIDRSKSYMYEQLWKLCAGPLCDIPKLGEKVYYFPQGNIELVEASTREELNELQPICDLPSKLQCRVIAIHLKVENNSDETYAKITLMPDTTQVVIPTQNENQFRPLVNSFTKVLTASDISANGVFSVPKKHAIECLPPLDMSQPLPAQELLAIDLHGNQWSFRHSYRGTPQRHLLTTGWNEFTTSKKLVKGDVIVFVRGETGELRVGIRRARHQQGNIPSSIVSIDCMRHGVIASAKHAFDNQCMFIVVYKPRSSQFIVSYDKFLDAVNNKFNVGSRFTMRFEGDDLSERRYFGTIIGVSNFSPHWKCSDWRSLEVQWDEFASFLRPNKVSPWEIEHLMPALNVPRSSFLKNKRLREVNEFEDAMNPSRLLMSYPVQPMPKRNYNNQMVTQIEENITTKAGTNFRLFGVSLATPPVIKDPIEQIGSDISKLTEGKKFGQSQTLRSPTKIQSKQFSSTRTCTKVSIRSIYSYSLYMKLFLIILTSHNFDMEQVQMQGVTIGRAVDLSVLNGYDQLILELEKLFDLKGQLQTRNQWKIIFTGSDEDEMLVGDDPWP

SEQ ID NO: 1695 - DNA, 1863 bp, Arabidopsis thaliana
  G2871,family:ARF
atgtacgagcagttatggaaactctgtgcagggcctttgtgtgatattccaaaacttggagaaaatgtttattactttcctcaaggcaatatagagcttgcatctacaagagaagagttgaatgagttacaaccaatttgtgatcttccttctaagcttcaatgtcgtgttattgcaattcatcttaaggtggaaaacaatagtgatgagatttatgctgagatcactttgatgccagatacaactcaagttgtaatccctactcagagtgaaaatcgatttaggccattagttaattcctttacaaaggttttaacggcctcagatacaagcgcttatggtggattctctgttccgaaaaaacatgccattgaatgtctccctccgctggatatgtctcagcctctaccggcacaagaaattcttgctatagatctccatgataatcaatggagattcagacacaactatagaggtacaccgcaaagacattcgttaacaactggttggaatgaattcataacatcaaagaaattggttaaaggagatgttattgtattcgttaggggagagactggagagttacgagttggtatcagacgagcaagacatcaacaagggaatataccttcatcaatagtatcaatagattgtatgagacatggggtaattgcttccgcaaagcatgcttttgataaccaatgtatattcattgtggtttacaagccaaggtttatattttgtgtctttataagtatcaggtcaagtcaatttattgtcagttatgacaaattcttagacgctgtgaacaataagtttaatgtcggttcaagatttacaatgcggtttgagggtgatgatttctctgaaagaagatattttgggacaattattggagttagtgatttctctcctcattggaagtgttcagagtggcgcagcttagaagtgcagtgggatgaatttgcatcattttcgagacctaataaagtgtcaccctgggagatcgaacatttagtgcctgcgttaaatgttccgcgatcatctttgctcaagaacaagcgtttacgagaagttaatgaattcggttcttcatcatcacatctcttgcctcctatattgacacaaggacaagaaattggacaactaagcgtggcctccccgatgaatatttctcttcgttatcgtgatacaactgaagctgctatgaatccttctagattgctaatgagctaccctgtccaaccaatgcccaaactaaattacaataaccaaatggttacacaaatagaagaaaatataacaaccaaggcaggcactaattttaggctgtttggagtcactctggacactcctccgatgatcaaagatcccattaaacaaattggctcggatatttcgaaacttactgaaagaaaaaagtttggtcaaagccaaactttgagatcaccaatagagatccaaagcaagcagttcagttcttctaggacttgtaccaaagtaagtataagatcaatatattcttattccttatatatgaaactttttctcattgtactcaactcacacaatctttatatggaacaggttcaaatgcaaggtgtaacaataggaagagctgtggatttaagtgttcttaatggatatgatcagctaatactagaattggagaagctctttgatatcaaaggccaattacaaactcgcaaccaatggaaaatagctttcacagatagtgacgggtatgagatgcttgttggagacgatccatggcctgaattctgcaaaatggtgaagaagatattgatatattcaaaagaggaggtcaaaaacctgaagtccagtaagagtctctcaagttga

SEQ ID NO: 1696 - protein, 620 aa, Arabidopsis thaliana
  G2871,ARF domain coordinates NA
MYEQLWKLCAGPLCDIPKLGENVYYFPQGNIELASTREELNELQPICDLPSKLQCRVIAIHLKVENNSDEIYAEITLMPDTTQVVIPTQSENRFRPLVNSFTKVLTASDTSAYGGFSVPKKHAIECLPPLDMSQPLPAQEILAIDLHDNQWRFRHNYRGTPQRHSLTTGWNEFITSKKLVKGDVIVFVRGETGELRVGIRRARHQQGNIPSSIVSIDCMRHGVIASAKHAFDNQCIFIVVYKPRFIFCVFISIRSSQFIVSYDKFLDAVNNKFNVGSRFTMRFEGDDFSERRYFGTIIGVSDFSPHWKCSEWRSLEVQWDEFASFSRPNKVSPWEIEHLVPALNVPRSSLLKNKRLREVNEFGSSSSHLLPPILTQGQEIGQLSVASPMNISLRYRDTTEAAMNPSRLLMSYPVQPMPKLNYNNQMVTQIEENITTKAGTNFRLFGVTLDTPPMIKDPIKQIGSDISKLTERKKFGQSQTLRSPIEIQSKQFSSSRTCTKVSIRSIYSYSLYMKLFLIVLNSHNLYMEQVQMQGVTIGRAVDLSVLNGYDQLILELEKLFDIKGQLQTRNQWKIAFTDSDGYEMLVGDDPWPEFCKMVKKILIYSKEEVKNLKSSKSLSS

SEQ ID NO: 1697 - DNA, 1848 bp, Arabidopsis thaliana
  G2872,family:ARF
atggaaactggcaacgttgtgaatgcacaacctgaattatcaggcataattgatggatccaagagctatatgtacgagcagttatggaaactctgtgcgggacctttgtgtgatattccaaaacttggagaaaatgtttattactttcctcaaggcaatatagagcttgttgatgcatctacaagagaagagttgaatgagttacaaccaatttgtgatcttccttctaagcttcaatgccgtgttattgcaattcatcttaaggtggaaaacaatagtgatgagacttatgctgagatcactttgatgccagatacaactcaagttgtaatccctactcagagtgaaaatcaatttaggccattagttaattcctttacgaaggttttaacggcctctgatacaagcgcttatggtggattctttgttccgaaaaaacatgccattgaatgtctccctccactggatatgtctcagcctctaccggcacaagaacttcttgctaaagatctccatggtaatcaatggagattcagacacagctatagaggtacaccgcaaagacattcgttaacaactggttggaatgaattcacaacatcgaaaaagttggttaaaggagatgttattgtattcgttaggggagagactggagagttacgagttggtatcagacgagcaagacatcaacaagggaatataccttcatcaatagtatcaatagattgtatgagacatggggtaattgcttccgcaaagcatgctcttgataaccaatgtatattcattgtggtttacaagccaaggtcaagtcaatttattgtcagttacgacaaattcttagacgctatgaacaataagttcattgtcggttcaagatttacaatgcggtttgagggtgatgatttctctgaaagaagatattttgggacaattattggagttaatgatttctctcctcattggaagtgttcagagtggcgcagcttagaagttcagtgggatgaatttgcatcattttcgagacctaataaagtgtcaccctgggagatcgaacatttaatgtctgcgttaaatgttccgcgatcatctttgctcaagaacaagcgtttacgagaaactcttgaataccttctcaatattcttgttttatatacatgttcttcatcatcacatatcttgcctcctatattgacacaaggacaagaaattggacaactaagcgtcgcctccccgatgaatacttctcttcgttatcgtgatacaactgaagatgctatgaatccttctagattgctaatgagctaccctgtccaaccaatgcccaaactaaattacaataaccaaatggttacacaaatagaagaaaatataacaaccaaggcagtcactaattttaggctgtttggagtctctctagccattcctctagtgatcaaagatcccattgaagaaattggctcggatatttcgaaacttactgaaggaaaaaagtttggtcaaagccaaactttgagatcaccaatagagatccaaagcaagcagtttggttctactagaacttgtaccaaagttcaaatgcaaggtgtaacaataggaagagctgtggatttaagtgttcttaatggatatgatcagctaatactagaattggagaagctctttgatctcaaaggccaactacaaactcgcaaccaatggaaaatagctttcacagatagtgacgggtatgagatgcttgttggagacgatccatggcctgaattctgcaaaatggtgaagaagatattgatatattcaaaagaggaggtcaaaaacctaaagtccagtaagagtctctcaagttga

SEQ ID NO: 1698 - protein, 615 aa, Arabidopsis thaliana
  G2872,ARF domain coordinates NA
METGNVVNAQPELSGIIDGSKSYMYEQLWKLCAGPLCDIPKLGENVYYFPQGNIELVDASTREELNELQPICDLPSKLQCRVIAIHLKVENNSDETYAEITLMPDTTQVVIPTQSENQFRPLVNSFTKVLTASDTSAYGGFFVPKKHAIECLPPLDMSQPLPAQELLAKDLHGNQWRFRHSYRGTPQRHSLTTGWNEFTTSKKLVKGDVIVFVRGETGELRVGIRRARHQQGNIPSSIVSIDCMRHGVIASAKHALDNQCIFIVVYKPRSSQFIVSYDKFLDAMNNKFIVGSRFTMRFEGDDFSERRYFGTIIGVNDFSPHWKCSEWRSLEVQWDEFASFSRPNKVSPWEIEHLMSALNVPRSSLLKNKRLRETLEYLLNILVLYTCSSSSHILPPILTQGQEIGQLSVASPMNTSLRYRDTTEDAMNPSRLLMSYPVQPMPKLNYNNQMVTQIEENITTKAVTNFRLFGVSLAIPLVIKDPIEEIGSDISKLTEGKKFGQSQTLRSPIEIQSKQFGSTRTCTKVQMQGVTIGRAVDLSVLNGYDQLILELEKLFDLKGQLQTRNQWKIAFTDSDGYEMLVGDDPWPEFCKMVKKILIYSKEEVKNLKSSKSLSS

SEQ ID NO: 1699 - DNA, 1803 bp, Arabidopsis thaliana
  G2873,family:ARF
atggaaagtggcaacattgtgaatgcacaacctgaattatcaggcataattgatggatccaagagttatatgtacgagcagttatggaaactctgtgcggggcctttgtgtgatattccaaaacttggagaaaagatttattactttcctcaaggcaatatagagcttgttgaggcatctacaagagaagagttgaatgagttaaaaccaatttgtgatcttccttctaagcttcaatgtcgtgttattgctattcaacttaaggtggaaaacaatagtgatgagacttatgctgagatcactttgatgccagatacaactcaagttgtaatccctactcaaaatgaaaatcaatttagaccattagttaattcctttacgaaggttttaacggcctcggatacaagcggtggattctttgttccaaaaaaacatgccattgaatgtcttcctcccctggatatgtctcagcctctaccgacacaagaacttcttgctacagatctccatggtaatcaatggagattcaaccacaactatagaggtacaccgcaaagacatttgttaacaactggttggaatgcattcacaacatcaaaaaaattggttgcaggggatgttattgtattcgttaggggagagactggagagttacgagttggtatcagacgagcaggacatcaacaagggaatataccttcatcaataatatcaatagaaagtatgagacatggggtgattgcttccgcaaagcatgcttttgataaccaatgtatgttcattgtggtttacaagccaagtatcagatcaagtcaatttattgtcagttacgacaaattcttagatgctgtgaacaataagttcaatgttggttcaagatttacaatgcggtttgagggtgatgatttctctgaaagaagatattttgggacaattattggagttagtgatttctctcctcattggaagtgttcagagtggcgcaacttagaagtgcagtgggatgaatttgcatcattttcgagacctaataaagtgtcaccctgggagatcgaacatttaatgcctgcgttaaatgttccgcgaccatctttgctcaagaacaagcgtttacgagaagttaatgaaatcggttcttcatcatcacatctcttgcctcctatattgacacaaggacaagaaattggccaactaagcgtggcctccccgatgaatatttctctcacttatcgtgatacaactgaagatgttatgaatccttctagattgctaatgagctaccctgtccaaccaatgcccaaactaaattacaataaccaaatggttacacaaatagaagaaaatataacaaccaagactggcactaattttaggctgtttggagtctcactggtcactccttcagtgatcaaagatcccattgaagaaattggctcggagatttcgaaacttactgaaggaaaaaagtttggtcaaagccaaactttgagatcaccaacagagatccaaagcaagcagttcagttctactagaacttgtaccaaagttcaaatgcaaggtgtaacaatagaaagagctgtggatttaagtgttctgaatggatatgatcagctaatactagaattggaggagctcttcgatctcaaaggccaattacaaactcgcaaccaatgggaaatagctttcacagatagtgacgatgataagatgcttgttggagacgatccatggcctgaattctgcaacatggtgaagaagatattgatattcaaaagaggaggtcaaaaacttgaagtccagtaa

SEQ ID NO: 1700 - protein, 600 aa, Arabidopsis thaliana
  G2873,ARF domain coordinates NA
MESGNIVNAQPELSGIIDGSKSYMYEQLWKLCAGPLCDIPKLGEKIYYFPQGNIELVEASTREELNELKPICDLPSKLQCRVIAIQLKVENNSDETYAEITLMPDTTQVVIPTQNENQFRPLVNSFTKVLTASDTSGGFFVPKKHAIECLPPLDMSQPLPTQELLATDLHGNQWRFNHNYRGTPQRHLLTTGWNAFTTSKKLVAGDVIVFVRGETGELRVGIRRAGHQQGNIPSSIISIESMRHGVIASAKHAFDNQCMFIVVYKPSIRSSQFIVSYDKFLDAVNNKFNVGSRFTMRFEGDDFSERRYFGTIIGVSDFSPHWKCSEWRNLEVQWDEFASFSRPNKVSPWEIEHLMPALNVPRPSLLKNKRLREVNEIGSSSSHLLPPILTQGQEIGQLSVASPMNISLTYRDTTEDVMNPSRLLMSYPVQPMPKLNYNNQMVTQIEENITTKTGTNFRLFGVSLVTPSVIKDPIEEIGSEISKLTEGKKFGQSQTLRSPTEIQSKQFSSTRTCTKVQMQGVTIERAVDLSVLNGYDQLILELEELFDLKGQLQTRNQWEIAFTDSDDDKMLVGDDPWPEFCNMVKKILIFKRGGQKLEVQ

SEQ ID NO: 1701 - DNA, 1089 bp, Arabidopsis thaliana
  G2888,family:Z-C2H2
atggagctgacgcaacccataagagaaaacggagacccgcagggacaccagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtga

SEQ ID NO: 1702 - protein, 362 aa, Arabidopsis thaliana
  G2888,Z-C2H2 domain coordinates 41-61,120-140
MELTQPIRENGDPQGHQLTDPDAEVVSLSPRTLLESDRYVCEICNQGFQRDQNLQMHRRRHKVPWKLLKRDKKDEEVRKRVYVCPEPTCLHHDPCHALGDLVGIKKHFRRKHSVHKQWVCERCSKGYAVQSDYKAHLKTCGSRGHSCDCGRVFSRVESFIEHQDTCTIRQPQPTNHRHLQQHTMGLDAPSRTTSTASFGPLLHGLPLLRPPRPSNQHSPAFAYPFNASSAPFESLELQLSIGMARTSAQARHNEKRETSLTKERANEEARKAEETRQEAKRQIEMAEKDFEKAKRIREEAKTELEKAHVVREEAIKRINATMMEITCHSCKQLFQLPVTADESTSSLVMSYVSSATTEGECE

SEQ ID NO: 1703 - DNA, 3819 bp, Arabidopsis thaliana
  G289,family:SWI/SNF
atgggtgaggaaggttcaatgtttggtctgggaggtgaatttccggttgatgattgtgatggtggttttgagtttgaagatgatgacgagactattgacatcgaaacgctttatcggattctagatgagaagcctgattctgctgaggtagttttctcggcttttgtgggtagccaagaaaacttatcaccagttggttcatctgctgacgagctcaaggattcacagttgctaaatggttcatttgatgaacatgtgaaaatggaagccgggctgagtccttcacctgctcatacttgctctgcaagtcttaaagattggttttcgttaagtcagggtgagcagcctgtggaaacatgtggagtatctcaatctgagatgactagttgtagtatatcgtctagtttctctgatcctgatggcaatatgatggccttcaatcctgtgaattgtgacgttgacactgtttccaagcaggatgataagataatcgattccaaatctatgttgactccatattttgacaacgtgactggatacggagtggggttgggagccaatcataattcgtctgccatgtctgttttttttaataattccaattccctcagtgacagtgcggataactatgtctcttctgcacaagattgctacaatacaagtggtacatccttgtcagaccatacccccaattctgttcagaatttcgcgtttgagttctttcctaataaagaagaagctgtaaatgatgttgagagtggagtaagtgagtctcagtcggatggtgccagccggatgatttttgatagacatggaagagtggataatggatctttagaaaggaaacctcctattgatttttctagtgcaagagggatcagtttcaagtttgaaagtaatccttcagtttctcctgcctgtgtcaaaccctacaacagttttgacagtcatttagctgatagtgaccttgaccggcctaataattattcatgcagttttcaggataataaaactgttcatgtgaaggttaaaccagaggctgaatcagagaaagttgtctacagttcagttccaggggaatttagtgtcagggatgatgcttatctttctggagaaaccaatcgttggtggtctggtgcatcaagctctgcagtctcctatcaaacagatattgaaaaaggatactcatatatggcaccgcaaacagctctacctagccaagacagtggcaagataagctccaatcatttttacgattcagatacatgtttgcaatatgttgtagaagatcccagcccagtgacacaaaacaatgagtataaagactttcaaattcaacaaggagaccgggaatatattcaaccgaggggcattgattctcaattctcaaatgccagctttgaatcagttcaaagccattcttcagaatgtatatccgatagtgatgatgattctgacgtctgcataatagaaccttatggtcaatctgcaatcccacatcgacctctagctatgaaaatgccggtagtttcttcagaatattctacagttagtcataattttaatcaatctggaggcctgaagcttcagtcaaataaagaaaatatgatctttcaagctgcattgcaggatctcactcagcctaattctgaagcaattctgcctgatggtgtcttgacagtcccgcttctgagacatcagcgaatcgcattgtcatggatggcccagaaggagacaagtggcttcccctgttcgggtggaattcttgctgatgatcagggtcttgggaagacagtttccactatagctcttatactgaaggaaaggtctaaacctgcccaagcatgtgaagaaagtacgaagaaagaaatttttgacctagaaagcgagactggagaatgtgcgcctttaaaacccagtggaagaagcaagcattttgaacactctcaattgctttccaatgaaaacaaagttggtggagacagtgtgggtaaagtgacgggaaggccagctgctggaacgcttgttgtatgtcccactagtgttatgcggcagtgggctgatgaattacataagaaggtgactagtgaagcaaatctctctgttctggtataccatgggtctagcagaacaaaggatcctcatgagttggctaaatatgatgttgttgttaccacattttctattgtaagtatggaagtgccaaagcagcctcttgttgatgatgaggatgaagagaaggatggtgtacatgatggtggaactgcagctactggcttttgctcaaacaagaaaaggaaatatcctcccgattctaaaaagaagggttcaaagaagaagaaagttgagtttctgtctggccctcttgcgaaagtttcatggtttagagttgttctagatgaggcacagagcattaaaaattacaaaacccaagttgcaagagcatgctggggccttcgtgctaaacggaggtggtgtttgtctggcactccaatccagaattcaatcgatgacctttacagctactttcgattcctcaaatatgatccttactcttcctacgtattgttctgtagcacgattaagaaccctataactaggaacccagtgaaaggatatcagaagctgcaggctatccttaaaacagtgatgcttcgccgaactaaaggttcacttcttgatgggaaacccataatctctttacctccgaagtccattgagttgagaaaagtggatttcactgtggaggaacgtgatttctactccaaactagaggctgaatctcgtactcaattcagggaatatgcagaagctggaacagtgaagcaaaattatgtaaatatcttgttgatgctcttgcgccttcgccaagcttgtgatcaccctcttctcgtgaatggtgaatacagttttacctgggaatcttctgttggattagctaagaagcagattcagtcagacgcttcattggcaatttgtggtatctgcaatgatgcacctgaagatgctgttgcttcagtttgcggtcatgttttctgtaaacagtgcatttatgaacgccttactggtgatagtaatcactgtccctttgcaaactgcaatgtcagactcaccatctcatcgttatcttccaaaacgagattggacgatgctatgcctgacatgcaggagcgtgctacttcgaatagccttagcccttgttctgatgaagatcttccatatggttcatctaaaatcaaggctgctctagagatcttacaatcactgcccaaagcacatgatttgacagattcaaatcagatctctgaaaacagagaatactccggtctttctataactcctgtgaagaatgagggtatgagcgttgatgttccgattaaggtagctggagaaaaagccattgttttttcccaatggacaaagatgctaaacctacttgaagcttctcttgtaagttcacatattcagtatagaaggctcgatggaacaatgtcagttgctgctagggataaagcagtgcaggatttcaacactctccctgaggttactgtaatgataatgtctctcaaggctgctagtctcggactgaacatggtggcagcttgtcatgttctgatgctggacttatggtggaacccaacaaccgaggatcaagcaatcgatagagcacatcgtataggacagacacgaccagtaacagtagttcgcttcacagtaaaagatacagtcgaagatcggatattagcccttcaggtctgtgaactggttgatttggttctcttcaatttctctataagctttaagccatttcatttttga

SEQ ID NO: 1704 - protein, 1272 aa, Arabidopsis thaliana
  G289,SWI/SNF domain coordinates 559-864,993-1031,1144-1227
MGEEGSMFGLGGEFPVDDCDGGFEFEDDDETIDIETLYRILDEKPDSAEVVFSAFVGSQENLSPVGSSADELKDSQLLNGSFDEHVKMEAGLSPSPAHTCSASLKDWFSLSQGEQPVETCGVSQSEMTSCSISSSFSDPDGNMMAFNPVNCDVDTVSKQDDKIIDSKSMLTPYFDNVTGYGVGLGANHNSSAMSVFFNNSNSLSDSADNYVSSAQDCYNTSGTSLSDHTPNSVQNFAFEFFPNKEEAVNDVESGVSESQSDGASRMIFDRHGRVDNGSLERKPPIDFSSARGISFKFESNPSVSPACVKPYNSFDSHLADSDLDRPNNYSCSFQDNKTVHVKVKPEAESEKVVYSSVPGEFSVRDDAYLSGETNRWWSGASSSAVSYQTDIEKGYSYMAPQTALPSQDSGKISSNHFYDSDTCLQYVVEDPSPVTQNNEYKDFQIQQGDREYIQPRGIDSQFSNASFESVQSHSSECISDSDDDSDVCIIEPYGQSAIPHRPLAMKMPVVSSEYSTVSHNFNQSGGLKLQSNKENMIFQAALQDLTQPNSEAILPDGVLTVPLLRHQRIALSWMAQKETSGFPCSGGILADDQGLGKTVSTIALILKERSKPAQACEESTKKEIFDLESETGECAPLKPSGRSKHFEHSQLLSNENKVGGDSVGKVTGRPAAGTLVVCPTSVMRQWADELHKKVTSEANLSVLVYHGSSRTKDPHELAKYDVVVTTFSIVSMEVPKQPLVDDEDEEKDGVHDGGTAATGFCSNKKRKYPPDSKKKGSKKKKVEFLSGPLAKVSWFRVVLDEAQSIKNYKTQVARACWGLRAKRRWCLSGTPIQNSIDDLYSYFRFLKYDPYSSYVLFCSTIKNPITRNPVKGYQKLQAILKTVMLRRTKGSLLDGKPIISLPPKSIELRKVDFTVEERDFYSKLEAESRTQFREYAEAGTVKQNYVNILLMLLRLRQACDHPLLVNGEYSFTWESSVGLAKKQIQSDASLAICGICNDAPEDAVASVCGHVFCKQCIYERLTGDSNHCPFANCNVRLTISSLSSKTRLDDAMPDMQERATSNSLSPCSDEDLPYGSSKIKAALEILQSLPKAHDLTDSNQISENREYSGLSITPVKNEGMSVDVPIKVAGEKAIVFSQWTKMLNLLEASLVSSHIQYRRLDGTMSVAARDKAVQDFNTLPEVTVMIMSLKAASLGLNMVAACHVLMLDLWWNPTTEDQAIDRAHRIGQTRPVTVVRFTVKDTVEDRILALQVCELVDLVLFNFSISFKPFHF

SEQ ID NO: 1705 - DNA, 610 bp, Arabidopsis thaliana
  G2895,family:HMG
gctctctcgtcaaacaaaaaaaaaaaacctaaagaaacttcgacatgaaaggcggcgaatccaaagctgaagcaacgagcactgatcagagactcaaaaccagaggtagaaaggctgggaagaagacgaagaaggatccaaatcaacctaagagacctccaagtgctttcttcgtcttccttgaggatttccgaaaagagtttaacctagcgaatcctaataacaaatccgtcgctactgttggtaaggctgctggagctagatggaaggcaatgactgatgaagataaagctccttacgtcgctaaggctgagagcagaaagactgaatatattaagaatgtgcaacagtacaacttgaaactggctagtggaaccaatagagaagaggatgactctgacaaatccaagtctgaagttgatgaagcagtaagcgaagaggaggcagaagacgacgattgaagcatctaggtcttgctattgacttgactcagatttgagaatgtaaacttgcttaggtttatgaccaaaaacttttaaaaaactcttatttatgctttgtgtttgtgatatttgaacctcatttgctacatcaatgttgttttaggtca

SEQ ID NO: 1706 - protein, 138 aa, Arabidopsis thaliana
  G2895,HMG domain coordinates 31-103
MKGGESKAEATSTDQRLKTRGRKAGKKTKKDPNQPKRPPSAFFVFLEDFRKEFNLANPNNKSVATVGKAAGARWKAMTDEDKAPYVAKAESRKTEYIKNVQQYNLKLASGTNREEDDSDKSKSEVDEAVSEEEAEDDD

SEQ ID NO: 1707 - DNA, 1451 bp, Arabidopsis thaliana
  G2903,family:HMG
cgaaatctcactctctctcattttcgactttagaaatggcgaccaacgcagatccagctccgacgaagaaaccaaggaacagtagaaaggcgttgaagcagaagaatgagctcgtggagacgccaccatcgcctgtctccgtcaaggggaagtcagcgaagtctttcgagcaagatctgatggagatgcagacaatgttggagaagatgaagatcgagaaggataagacggaggagttacttaaggagaaggatgagattctgagaaagaaggaggaggagctagagaccagagacgctgagcaggagaagctcaaggtggagctgaagaagcttcagaagatgaaggaattcaaacctaacatgacttttgcttgcggtcagtcatctctcacacaggctgagcaagaaaaggcgaataagaagaagaaaaaggattgtcctgagacaaagcgaccatcgtcctcatacgttttgtggtgtaaagatcaatggactgaagtcaagaaggaaaaccctgaggctgacttcaaggagacttcgaacattctgggggctaaatggaagtctcttagtgcagaagataagaagccttacgaggaaaggtaccaggttgagaaagaagcttacctccaggtcattgctaaggagaagcgcgagaaggaggccatgaagcttctggaggatgaccagaagcagagaactgcaatggaattgcttgatcagtatctcaactttgtccaggaagctgaacaggacaacaagaagaagaacaagaaggagaaggaccctctgaagccaaaacatcccgtatctgccttccttgtttatgcaaacgagaggagagctgctttacgcgaagaaaacaaaagcgtcgtggaggtcgcaaagatcactggagaggagtggaagaacttgtcagacaagaaaaaggcaccctacgagaaggtggcaaagaagaacaaggagacatacctgcaagcaatggaggaatacaagaggacaaaggaagaagaagccctgagtcagaagaaagaagaagaggaactcttgaaactccacaaacaagaagctcttcaaatgcttaagaagaaggagaaaactgataatctgatcaagaaggagaaggcgaccaagaagaagaagaacgaaaacgttgaccctaacaaaccaaagaagcctgcttcttcatactttctcttcagcaaggacgaaaggaagaaattgacagaagaacgtcccgggacaaacaacgctactgttactgctctcatttcactgaaatggaaggaattgagtgaagaagagaagcaagtttacaacggaaaggccgcaaaactgatggaagcatacaaaaaggaagtggaagcttacaacaagaagtctgcggctactaccagtagctagataaatctctcttagtattgaaatcatgttcaagtcctgttgaac

SEQ ID NO: 1708 - protein, 456 aa, Arabidopsis thaliana
  G2903,HMG domain coordinates 137-207,251-320,378-448
MATNADPAPTKKPRNSRKALKQKNELVETPPSPVSVKGKSAKSFEQDLMEMQTMLEKMKIEKDKTEELLKEKDEILRKKEEELETRDAEQEKLKVELKKLQKMKEFKPNMTFACGQSSLTQAEQEKANKKKKKDCPETKRPSSSYVLWCKDQWTEVKKENPEADFKETSNILGAKWKSLSAEDKKPYEERYQVEKEAYLQVIAKEKREKEAMKLLEDDQKQRTAMELLDQYLNFVQEAEQDNKKKNKKEKDPLKPKHPVSAFLVYANERRAALREENKSVVEVAKITGEEWKNLSDKKKAPYEKVAKKNKETYLQAMEEYKRTKEEEALSQKKEEEELLKLHKQEALQMLKKKEKTDNLIKKEKATKKKKNENVDPNKPKKPASSYFLFSKDERKKLTEERPGTNNATVTALISLKWKELSEEEKQVYNGKAAKLMEAYKKEVEAYNKKSAATTSS

SEQ ID NO: 1709 - DNA, 1350 bp, Arabidopsis thaliana
  G291,family:MISC
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 1710 - protein, 357 aa, Arabidopsis thaliana
  G291,MISC domain coordinates 132-160
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 1711 - DNA, 1158 bp, Arabidopsis thaliana
  G2981,family:E2F
atgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctggtgttaagaagaagaagaggggacagcgtgcggctggtccagataagactggaagaggactacgtcaatttagtatgaaagtttgtgaaaaggtggaaagcaaaggaaggacaacttacaatgaggttgcagacgagcttgttgctgaatttgcacttccaaataacgatggaacatcccctgatcagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaagaacgaacgactctcacttaggaacagaattgagaagaaaactgcatattcccaagaactggaagaacaatatgtaggccttcagaatctgatacagagaaatgagcacttatatagctcaggaaatgctcccagtggcggtgttgctcttccttttatccttgtccagactcgtcctcacgcaacagtagaagtggagatatcagaagatatgcagctcgtgcattttgatttcaacagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattga

SEQ ID NO: 1712 - protein, 385 aa, Arabidopsis thaliana
  G2981,E2F domain coordinates 155-173
MTTTGSNSNHNHHESNNNNNNPSTRSWGTAVSGQSVSTSGSMGSPSSRSEQTITVVTSTSDTTFQRLNNLDIQGDDAGSQGASGVKKKKRGQRAAGPDKTGRGLRQFSMKVCEKVESKGRTTYNEVADELVAEFALPNNDGTSPDQQQYDEKNIRRRVYDALNVLMAMDIISKDKKEIQWRGLPRTSLSDIEELKNERLSLRNRIEKKTAYSQELEEQYVGLQNLIQRNEHLYSSGNAPSGGVALPFILVQTRPHATVEVEISEDMQLVHFDFNSTPFELHDDNFVLKTMKFCDQPPQQPNGRNNSQLVCHNFTPENPNKGPSTGPTPQLDMYETHLQSQQHQQHSQLQIIPMPETNNVTSSADTAPVKSPSLPGIMNSSMKPEN

SEQ ID NO: 1713 - DNA, 1050 bp, Arabidopsis thaliana
  G2988,family:MADS
atggtgaaaggcacgaagagaaagattgcgattgagacgatacagaagagagattcccttagggttacctgcaccaaacgccgtaaaggtctctatagcaaagcctctcagctttgtcttctctccgacgcacaaatcgctatcttagcgactcctccttcttctgaatccgacgtctctttctactctttcggtcactcctctgttgatgccgttgtctctgcttttctctccggaaaacgtcctgtttcggctccgaaggataacaaagagacgagggaggacgttggtatctgtttgactcgcaagaatctagggttagggttttggtggaatgacgagagccttgtgagatcggagaatcctcaagagattagtgaagcgatcggttccatgtggactctgttgagtaatctcaaggagttgcgtgcggatgaagcttgcgttaacgatcacaaggacttgaagaagaatgagaagagcgatgttcacggaactcaagatcaaaccctaatttttcagtccgcttctgcagtttgttgcatccctgaaaatctcaacgatattactcaagagccaaatcaaaccctagatattcagtccagtagttctgcaatctgttgcgtccctgataaatcacctgaaattttcaatgaaatcactgaagaacaagatcagattctctcgatttgtgaaactttttgtgttacggataataacaacaacaacaacaacaacgctgctttacctgaagttaacctatattacaatcaagacatggctattgatcaactcattgacttcaacaccccttttgaaagctcgatagatgattggttttcggacaacactactcatcaggagacgactagtgcaagtattttgaacgatgttggtgttgatgatcaagtctcggtggatacaaatccgttttcttattttcaaagccttgaagatgcagatttggtgtttcagagatgtttggatggagataatctacgattctctgattgtttcaatgactttgcaaacactattgcagcagtttga

SEQ ID NO: 1714 - protein, 349 aa, Arabidopsis thaliana
  G2988,MADS domain coordinates 4-60
MVKGTKRKIAIETIQKRDSLRVTCTKRRKGLYSKASQLCLLSDAQIAILATPPSSESDVSFYSFGHSSVDAVVSAFLSGKRPVSAPKDNKETREDVGICLTRKNLGLGFWWNDESLVRSENPQEISEAIGSMWTLLSNLKELRADEACVNDHKDLKKNEKSDVHGTQDQTLIFQSASAVCCIPENLNDITQEPNQTLDIQSSSSAICCVPDKSPEIFNEITEEQDQILSICETFCVTDNNNNNNNNAALPEVNLYYNQDMAIDQLIDFNTPFESSIDDWFSDNTTHQETTSASILNDVGVDDQVSVDTNPFSYFQSLEDADLVFQRCLDGDNLRFSDCFNDFANTIAAV

SEQ ID NO: 1715 - DNA, 1083 bp, Arabidopsis thaliana
  G2994,family:ZF-HB
ccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaat

SEQ ID NO: 1716 - protein, 312 aa, Arabidopsis thaliana
  G2994,ZF-HB domain coordinates 88-141,218-281
MEIASQEDHDMPIPLNTTFGGGGSHGHMIHHHDHHAANSAPPTHNNNNTTQPPPMPLHGNGHGNNYDHHHHQDPHHVGYNAIIKKPMIKYKECLKNHAAAMGGNATDGCGEFMPSGEDGSIEALTCSACNCHRNFHRKEVEGELAATAMSPYHQHPPHRKLMLNHQKIRSAMPHQMIMPIGVSNYRYMHNNSESEDFMEEDGVTTASRSLPNLPYNQKKRFRTKFTPEQKEKMLSFAEKVGWKIQRQEDCVVQRFCEEIGVKRRVLKVWMHNNKIHFSKKNNINLEDNDNEKINNLNNVDLSGNNDMTKIVP

SEQ ID NO: 1717 - DNA, 1524 bp, Arabidopsis thaliana
  G3027,family:bZIP
gacacgaaccaatcaccaaaaaatttctacctcttttgattctaatcaatctcactccaatttctgcaaaaatcaaaccttttttttatattcatttcacatctctgtttttcctcagattcctcaaacattacagatcttcaggttttctatttataagcagaacttgttctgttcttgtgtgaagctttcactggttttggaaattggtgaatgtgattaatgggtagcagtgagatggaaaaatcaggtaaagagaaagaacctaagactacaccgccttcgacttcttcatctgctcctgctactgttgtttcacaggaaccttcttctgctgtgagtgctggagtggctgttactcaagattggtctggcttccaggcttattctcctatgccgcctcatggttatgtagcatcaagtcctcaacctcatccttatatgtggggcgttcagcatatgatgccgccttatggaacaccgcctcatccgtatgttacgatgtatcctccaggtggcatgtatgctcatccttcattacctccggggtcttatccatatagtccctatgcaatgccttctcctaatggaatggctgaagcttctggtaatactggaagtgttattgagggtgatggtaaaccatctgatgggaaggaaaaattgccaatcaaaagatcaaaaggaagcttgggaagtttgaatatgattataggaaagaacaatgaagctggaaaaaactcaggagcatcagctaatggagcttgttctaaaagtgctgagagcggttctgatggatcaagtgacggaagtgatgcaaattcacaaaacgactctggctctagacacaacgggaaggatggtgaaacagcttcagagagtggtggttctgctcatggaccaccccgtaatggaagtaatctaccagtgaaccagaccgtcgctatcatgccagtgtcggctacaggtgttccaggcccaccaacaaatctaaatatcggaatggattattggagcggtcatgggaatgtttctggagcagttcctggagttgtagtagatggttcccaatcacagccatggttacaggtttctgatgagagagagattaagcgacagagacggaagcaatccaatagggaatctgctcgtagatccaggttgcgtaaacaggcggagtgtgatgagctagcacaacgagcagaggttttgaatggagagaactcaagtcttagagcagaaattaacaagcttaaaagccaatatgaagagcttcttgctgaaaatagctctctcaagaataagttctcgtcagccccgtcactggaaggtggagacttggacaagaacgagcaagaaccacagagaagtacacgtcaggatgttgcgtagacggctcgtggttccttccacaactcagcttgactcaagaacagcagctaacagatatatgtaattttaggaaccagatttggtgtgatttctttagtgtttaaataggaggaagcatgaaaaaaaaaaaaa

SEQ ID NO: 1718 - protein, 389 aa, Arabidopsis thaliana
  G3027,bZIP domain coordinates 70-75,80-87,101-104,285-327
MGSSEMEKSGKEKEPKTTPPSTSSSAPATVVSQEPSSAVSAGVAVTQDWSGFQAYSPMPPHGYVASSPQPHPYMWGVQHMMPPYGTPPHPYVTMYPPGGMYAHPSLPPGSYPYSPYAMPSPNGMAEASGNTGSVIEGDGKPSDGKEKLPIKRSKGSLGSLNMIIGKNNEAGKNSGASANGACSKSAESGSDGSSDGSDANSQNDSGSRHNGKDGETASESGGSAHGPPRNGSNLPVNQTVAIMPVSATGVPGPPTNLNIGMDYWSGHGNVSGAVPGVVVDGSQSQPWLQVSDEREIKRQRRKQSNRESARRSRLRKQAECDELAQRAEVLNGENSSLRAEINKLKSQYEELLAENSSLKNKFSSAPSLEGGDLDKNEQEPQRSTRQDVA

SEQ ID NO: 1719 - DNA, 318 bp, Arabidopsis thaliana
  G3065,family:Z-C2H2
atgactggtaaggccaagccaaagaagcatacagcgaaggagattcaagcgaagatcgatgctgcgttgactaatcgaggcggaggaaaagctggaatcgctgatcggaccggaaaagagaaaggaggccacgctaagtacgagtgtcctcattgcaaaattacggctccaggtcttaagacgatgcagatccatcacgaatcgaagcatcctaatatcatttatgaggaatcaaagctcgtgaatctccatgctgttttagcaccagtagctgaatcgaaacctaaacctggtatcaggggaagcttgaagaagtaa

SEQ ID NO: 1720 - protein, 105 aa, Arabidopsis thaliana
  G3065,Z-C2H2 domain coordinates 49-70
MTGKAKPKKHTAKEIQAKIDAALTNRGGGKAGIADRTGKEKGGHAKYECPHCKITAPGLKTMQIHHESKHPNIIYEESKLVNLHAVLAPVAESKPKPGIRGSLKK

SEQ ID NO: 1721 - DNA, 1764 bp, Arabidopsis thaliana
  G307,family:SCR
atgaagagagatcatcaccaattccaaggtcgattgtccaaccacgggacttcttcttcttcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcggctgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagctcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcgcttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgcccactcattaccacctccgcttggaaactctcgacggcggcgcactga

SEQ ID NO: 1722 - protein, 587 aa, Arabidopsis thaliana
  G307,SCR domain coordinates 292-357,417-502,505-580
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 1723 - DNA, 944 bp, Arabidopsis thaliana
  G3079,family:bZIP-ZW2
taaccagctaaaaacaataagagagatatggaaagatcttcgagttatggggttgaaaaacttcaaaaaagatgttaccatgagtggatgagtttacaaactaaacacatagatgatctcaaagaagcactcatgtgtcaacgaaacaacgatgacaaactcgaagacctcgttggtaaaatcgtcaatgactaccacacatatgcgggaaaacgatcagagctctcgtaccgatgctgcgctcactactttgcaccgtcgtggaacactcctatagagaacagtatgctatggatgggaggatgtcgtccttcttctttcattagacttatatacgcactttgtggatcccaggccgaaactcagctttctcaatatcttcttaagatcgatgacgacttcgatataaaccatggtggtttcatgagtgatcttaccgcgacacagcttggaaaactcaatgacttgcatttggaggtaataaagaaagaagacaagattacgaagacatctgcgaattttcaagacgatgtggcggatttgccaatcgcggatgtggtgcatgctgatgtagcggtggaggatgctttggataagcatgaagagggaatggcggttttactggcggaggctgataaactgaggtttgagacgcttaggaagattgtggacgttgtcacaccgcttcaagcggtggagtttttgcttgccggaaaaagattacagctgtcgttgcacgaccggggaagagttagagcagatgtttgtggaggagtggggggcgccgctgtctgaagaggtgaggtggagcggggatgtcagacagagccacttgttaaagtgcgtgtcagtcagtagcgtataatatatgtgtaatatttgtctaattagagatgggtcatgtttagtgtgtgcttcatgtgtatgagatgttgcattattat

SEQ ID NO: 1724 - protein, 255 aa, Arabidopsis thaliana
  G3079,bZIP-ZW2 domain coordinates 74-104,202-229
MERSSSYGVEKLQKRCYHEWMSLQTKHIDDLKEALMCQRNNDDKLEDLVGKIVNDYHTYAGKRSELSYRCCAHYFAPSWNTPIENSMLWMGGCRPSSFIRLIYALCGSQAETQLSQYLLKIDDDFDINHGGFMSDLTATQLGKLNDLHLEVIKKEDKITKTSANFQDDVADLPIADVVHADVAVEDALDKHEEGMAVLLAEADKLRFETLRKIVDVVTPLQAVEFLLAGKRLQLSLHDRGRVRADVCGGVGGAAV

SEQ ID NO: 1725 - DNA, 1951 bp, Arabidopsis thaliana
  G308,family:SCR
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 1726 - protein, 532 aa, Arabidopsis thaliana
  G308,SCR domain coordinates 239-304,364-449,452-527
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 1727 - DNA, 1755 bp, Arabidopsis thaliana
  G312,family:SCR
atggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataa

SEQ ID NO: 1728 - protein, 584 aa, Arabidopsis thaliana
  G312,SCR domain coordinates 289-355,414-503,503-583
MAYMCTDSGNLMAIAQQVIKQKQQQEQQQQQHHQDHQIFGINPLSLNPWPNTSLGFGLSGSAFPDPFQVTGGGDSNDPGFPFPNLDHHHATTTGGGFRLSDFGGGTGGGEFESDEWMETLISGGDSVADGPDCDTWHDNPDYVIYGPDPFDTYPSRLSVQPSDLNRVIDTSSPLPPPTLWPPSSPLSIPPLTHESPTKEDPETNDSEDDDFDLEPPLLKAIYDCARISDSDPNEASKTLLQIRESVSELGDPTERVAFYFTEALSNRLSPNSPATSSSSSSTEDLILSYKTLNDACPYSKFAHLTANQAILEATEKSNKIHIVDFGIVQGIQWPALLQALATRTSGKPTQIRVSGIPAPSLGESPEPSLIATGNRLRDFAKVLDLNFDFIPILTPIHLLNGSSFRVDPDEVLAVNFMLQLYKLLDETPTIVDTALRLAKSLNPRVVTLGEYEVSLNRVGFANRVKNALQFYSAVFESLEPNLGRDSEERVRVERELFGRRISGLIGPEKTGIHRERMEEKEQWRVLMENAGFESVKLSNYAVSQAKILLWNYNYSNLYSIVESKPGFISLAWNDLPLLTLSSWR

SEQ ID NO: 1729 - DNA, 864 bp, Arabidopsis thaliana
  G313,family:SCR
atggtgtcagtctcaggcagtccgatccaacggctaggcacttacatggcagaagggcttagagcgaggcttgaggggtctgggagcaatatatacaaatccttgaaatgcaatgaaccaacgggaagggaactgatgtcttacatgagtgttctctatgaaatctgcccctactggaaattcgcgtacacaactgcgaatgttgagatcttggaagcaatagctggggaaaccagagtccacattatcgattttcagattgcacagggatcacaatacatgtttttgattcaggagcttgcgaaacaccctggtgggccgccgttgctgcgtgtgacgggtgtggatgattcacagtccacctatgctcgtgggggaggactcagcttggtaggtgagaggcttgcaactttggcgcagtcatgtggtgtcccgtttgagtttcacgatgccatcatgtctgggtgcaaggtgcagcgggaacatctcgggttggaacctggctttgctgttgttgtgaacttcccatatgtattacaccacatgccagacgagagcgtaagtgttgaaaatcacagagacaggctgctgcatctgatcaagagcctctccccaaaactggttactctagtagagcaagaatccaacacaaacacctcgccattcctgtcacggtttgtggaaacactggattactacacagcgatgtttgagtcgatagatgcagcacggccacgggatgataagcagagaatcagcgcagaacaacactgtgtagcaagagacatagtgaacatgatagcatgtgaggagtcagagagagtagagagacacgaggtactgggaaatggagggtcagaatga

SEQ ID NO: 1730 - protein, 287 aa, Arabidopsis thaliana
  G313,SCR domain coordinates 49-114,177-265
MVSVSGSPIQRLGTYMAEGLRARLEGSGSNIYKSLKCNEPTGRELMSYMSVLYEICPYWKFAYTTANVEILEAIAGETRVHIIDFQIAQGSQYMFLIQELAKHPGGPPLLRVTGVDDSQSTYARGGGLSLVGERLATLAQSCGVPFEFHDAIMSGCKVQREHLGLEPGFAVVVNFPYVLHHMPDESVSVENHRDRLLHLIKSLSPKLVTLVEQESNTNTSPFLSRFVETLDYYTAMFESIDAARPRDDKQRISAEQHCVARDIVNMIACEESERVERHEVLGNGGSE

SEQ ID NO: 1731 - DNA, 930 bp, Arabidopsis thaliana
  G314,family:SCR
atgaacacaacccaaattctaaacccgacccgacccatttggcccagtttctcttcgtccaaatctcttagcggtgatgctaactgcatggagcagcttctcctccattgcgcaaacgccatcgaatcaaacgacgccacgttggctcaacagatcatttgggtgctcaacaacctcgcttcacccgacggcgactcaactcaaagactcgctgcctctttcctccgcgcgttaatatcacgcaccgcctccaaaagccctgcgtttgcgtttctatcactggctgctacagcttccatatcccagaaaacgctacaccggttctccgtcatagagctcgctgagttcgtcgacttgacgccatggcaccgtttcggattcatagccgccaacgccgcaatcctcgacgccgtagaaggttactcatccgttcacatcgttgacttaagtttgactcactgcatgcaaatccctactcttatagactccatggcaaacaaactccacaaaaaaccgcctccgcttctcaaactcaccgtcattgcttccgacgctgaatttcatccgccgccgttgctcggaatctcctacgaagagctaggttcaaagctagtaaacttcgcaaccacacgtaacgttgcaatggagtttagaatcatatcttcttcttactccgacggcctctcctcccttatcgaacaactaagaatcgacccattcgtcttcaacgaagctctcgtcgttaactgccacatgatgcttcactatatccccgacgaaatattaacttcgaatctccgatcagttttcttgaaagaacttcgagatctaaacccaacgatcgtaacccttatcgacgaagactcggatttcacgtcgactaactttatctccaggtttatcttttttcggttctatttcaaaatttaa

SEQ ID NO: 1732 - protein, 309 aa, Arabidopsis thaliana
  G314,SCR domain coordinates 113-180
MNTTQILNPTRPIWPSFSSSKSLSGDANCMEQLLLHCANAIESNDATLAQQIIWVLNNLASPDGDSTQRLAASFLRALISRTASKSPAFAFLSLAATASISQKTLHRFSVIELAEFVDLTPWHRFGFIAANAAILDAVEGYSSVHIVDLSLTHCMQIPTLIDSMANKLHKKPPPLLKLTVIASDAEFHPPPLLGISYEELGSKLVNFATTRNVAMEFRIISSSYSDGLSSLIEQLRIDPFVFNEALVVNCHMMLHYIPDEILTSNLRSVFLKELRDLNPTIVTLIDEDSDFTSTNFISRFIFFRFYFKI

SEQ ID NO: 1733 - DNA, 812 bp, Medicago truncatula
  G3362,family:AP2
ttactaaccacactgttcttcaactagtagaattataacaaactttccttctactattcttttttttttttttttggaacatgtttactatgaatcaattttcggagtcacatgatccatgttcatcatcttcagagaggtttcttgcagagaccatgccaaagaagcgtgcagggaggaagaagttcagagaaacacgccaccctgtgtaccgtggtgtaagaaaaagggattccgggaagtgggtttgcgaagtaagagaacctaacaagaaaaccagaatttggcttggaacattccctacaccggagatggcggcgcgtgcgcatgatgtcgctgcgattgcactgagaggaaggtctgcttgtcttaactttgctgattctgcttggaagttgccggttccggctacgtcggaagcaagggatattcaaaaggcggcggctgaggcagcggaggctttcaggccggagagtgtgtttgagaatagtgaagagaggaaggatagtgagccttcgtcgacagtggcggtgtcggagacggtgatggagcaacgggaggaggaagaggatacggtgccggagtatttgagaaacatggtgctaatgtcaccggcacattactggggaagtgattgtggtgttgctgacgtggaatttgatgaaactgaagtttcattgtggagttactcattttaatttaatttaagataaatatctaaacattagtacattactagtaccaaattgaggaataaattgtttgtgcaggaagttcgtactaggatagtgtcttaacaaaaaaaaaaaagg

SEQ ID NO: 1734 - protein, 205 aa, Medicago truncatula
  G3362,AP2 domain coordinates 41-108
MFTMNQFSESHDPCSSSSERFLAETMPKKRAGRKKFRETRHPVYRGVRKRDSGKWVCEVREPNKKTRIWLGTFPTPEMAARAHDVAAIALRGRSACLNFADSAWKLPVPATSEARDIQKAAAEAAEAFRPESVFENSEERKDSEPSSTVAVSETVMEQREEEEDTVPEYLRNMVLMSPAHYWGSDCGVADVEFDETEVSLWSYSF

SEQ ID NO: 1735 - DNA, 820 bp, Medicago truncatula
  G3364,family:AP2
tctttccttcaaaaccaagtatgcttcactatatatgtaacacaccttactcttcattctcttaaaaacaactatctctccaacacatacatatgtttactactaacaactcttcctattcacactccatttcctcagaagcatcttcttcctactataactcattaccggaatcggagatacgattagcagctagtaacccgaagaagagagcagggaggaagatattcaaggaaactcgccacccggtgtatagaggtgtaaggaagaggaacttagataaatgggtttgtgaaatgagggaacccaacacgaagactagaatttggctaggaacttttccaacagccgagatggcagcccgagcccacgatgttgctgcgatggcattgaggggtcgctacgcctgtctcaattttgcagattcggtgtggcggcttcctattccagcaacttcctcaataaaagatattcaaaaggcagctacaaaagccgccgaagcttttagaccagacaatactataatgattaccaacattgagactgttgtagctgttgtcgccacaaaggagttgaatatgttttgtgtggaagaagaagaggaaatgttgaatatgccggagttttggaggaatatggcactaatgtcccctacacatagctttgagtatcatgatcaatatgaagattttcattttcaagactttcaagatgatgaggtatcactatggaacttctaaattttctttgtttggtttaactttatttttggattgtagaataggaaatgtctatactacaacctttttaattggtagca

SEQ ID NO: 1736 - protein, 215 aa, Medicago truncatula
  G3364,AP2 domain coordinates 51-114
MFTTNNSSYSHSISSEASSSYYNSLPESEIRLAASNPKKRAGRKIFKETRHPVYRGVRKRNLDKWVCEMREPNTKTRIWLGTFPTAEMAARAHDVAAMALRGRYACLNFADSVWRLPIPATSSIKDIQKAATKAAEAFRPDNTIMITNIETVVAVVATKELNMFCVEEEEEMLNMPEFWRNMALMSPTHSFEYHDQYEDFHFQDFQDDEVSLWNF

SEQ ID NO: 1737 - DNA, 747 bp, Medicago truncatula
  G3365,family:AP2
cacgaggcgcataaaccataagctactttactactagtactactacatacaccccacaaatgaaatcatcacttgatgagtctagttacgtagagaacaactcttcttcatcagaaatcttgttagcatcagaacaaccaaagaaacgtgcgggtcgacgaaaattcaaggagacaagacatccagtatacagaggagtacgaagaaggaacaacaacaacaacaagtgggtttgtgaagtgcgtgttcctaacgacaagtccacgaggatttggcttggaacatatccaacacctgagatggcagcacgtgcacacgacgttgccgcactggcacttcgcggtaaatcagcttgtcttaattttgctgactctgcgtggcggttagcgttgccggcgacgaacaatgcgaaggagattaggaaaatggcggcggaggctgctttggcatttgccgtagttgcggacagtaaggaacaaactatgattagtaattgtgatgttaatagtgttggtgttatggaagttgataataaacctttgcagggactgtgtgtggaagttccagaggaggaaatgttgcatgattggtttaggagtatggctgatgagccattacgatctcctattactccatttataagacatggcagggatcagtggaataatgttgatattgatcaggttgatgctgaggtctccttgtggaactttaccatctaatctatgagatgcattttgctttttg

SEQ ID NO: 1738 - protein, 220 aa, Medicago truncatula
  G3365,AP2 domain coordinates 41-108
MKSSLDESSYVENNSSSSEILLASEQPKKRAGRRKFKETRHPVYRGVRRRNNNNNKWVCEVRVPNDKSTRIWLGTYPTPEMAARAHDVAALALRGKSACLNFADSAWRLALPATNNAKEIRKMAAEAALAFAVVADSKEQTMISNCDVNSVGVMEVDNKPLQGLCVEVPEEEMLHDWFRSMADEPLRSPITPFIRHGRDQWNNVDIDQVDAEVSLWNFTI

SEQ ID NO: 1739 - DNA, 931 bp, Medicago truncatula
  G3366,family:AP2
caaaaacaacaacatctttacttcataataacaaacacttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttggggtattatgagtatcaatatattaatgaagactttcaagatgaggaagtatcactatggagtttttaaattttttgtaggaaaatggaattttttagtttgatccgtttggtttacatttatttattttttgattgtagaatggaaattgtaaaatagtacaaacctttttagtagtagtacggattcttgataggtttaaattggaaagaaaaaaa

SEQ ID NO: 1740 - protein, 227 aa, Medicago truncatula
  G3366,AP2 domain coordinates 53-117
MYPTTNSVSSSSSDMSLPNSEGSHWMSICNEEMRLAATTPKKRAGRKKFKETRHPVYRGVRKRNLDKWVCEMREPNKKTKIWLGTFPTAEMAARAHDVAAMALRGRYACLNFADSAWRLPKPATTQAKDIQKAATEAAEAFRPDKTLLTNHNDNDNDNDKENDMAVVATATEEQSMICMEEKEEGVMNMQEMWSNMALMSPTHSLGYYEYQYINEDFQDEEVSLWSF

SEQ ID NO: 1741 - DNA, 1271 bp, Medicago truncatula
  G3367,family:AP2
aaacaaactctctccaattaccactttacctctcaaaaccattttccactctatccaacacatacatatgataagtactaacaactcttcctattcacactccatttcctcaaaagatttttctcccttcgacgcatcatcaccggattctgaggtgcggttagcatcaagcaacccgaagaagagagcggggaggaagatatttaaggaaactcgtcaccctgtctatagaggtgtgaggaagaggaacttaaataaatgggtttgtgaaatgagggagccgaacacaaagaataggatttggctaggaacttttccaacagccgagatggcagcccgagcccacgatgttgccgcgatagcattgaggggccgctatgcctgtctcaattttgcagactcggtgtggcgccttcctattccagcaacttccgcgataaaagatattcaaaaggcagctacaaaagccgccgaagcttttagaccagacaatactttaatgaccagtgacattgacaccgttgtagctgttgtcgcaacacaggagctgaatatgtttcgtgttgaagtcgaagaagaggaagtgttgaatatgccagagttgtggaggaatatggcactaatgtcccctacacatagctttgggtatcatgatcagtatgaagatattcatatacaagactttcaagatgatgaggtatcactatggaacttttaaatttaattgatttggttttacatttatttttggattgtagaataggaaatgtctatactacaaccgtttgaattggtagcgtaaactctgcatatacataggttgaatttgaaaaggaatttatttttatagcttttatgtgaattattaaatcactaatcaagcgtaaagtgcatctcatcctttttattatatatgaaagaaaatataattttggaatttcagctattgatatagaaaatataatctattgccatctttgcttagcctgtattaagttgaagaaggtaatacggtgtctcttgtcttattcttctcttctcttttgtaggactttaaaaaaaggtctgttacgacgatctgggctgtgacttcaattggggtgcattcgctgcatttcaccgtcatatcaaggattgtgatgcgaaccttgcttttatgtgtctgatttctgtgttttcatcctggcaaggaaagctacaagagaagaatgaatgaaatttaagcagatgccagtaattaatatcctctgcaatttcctcatgtatttggt

SEQ ID NO: 1742 - protein, 216 aa, Medicago truncatula
  G3367,AP2 domain coordinates 51-114
MISTNNSSYSHSISSKDFSPFDASSPDSEVRLASSNPKKRAGRKIFKETRHPVYRGVRKRNLNKWVCEMREPNTKNRIWLGTFPTAEMAARAHDVAAIALRGRYACLNFADSVWRLPIPATSAIKDIQKAATKAAEAFRPDNTLMTSDIDTVVAVVATQELNMFRVEVEEEEVLNMPELWRNMALMSPTHSFGYHDQYEDIHIQDFQDDEVSLWNF

SEQ ID NO: 1743 - DNA, 795 bp, Medicago truncatula
  G3368,family:AP2
accaaccaaaaaaaaatcccaatctaaattcgaaaaatggatttcttcatgtcatcatttagtgattactcagacacttcttcatcagaaacagcttcatcaaaccgtacaagttcttcagaagtgattttggcacctgcaagaccaaagaagagagcaggtagaagagtgttcaaggagacaagacatccggtgtaccgaggagtacgacgtaggaagaataacaagtgggtttgtgagatgagagttcctaacaatatcgttaacaaaaataataagtcaaggatttggcttggaacatatccaactcctgaaatggctgcacgtgcacatgatgttgctgcacttactcttaaaggaaaatcagcttgtcttaattttgctgactctgcatggcggttgaggttgccggagtcgaatgatgcgacggagataaggagggcggcgatggaggctgctcagttgtttgcggttgaagacaagcaatgttgtgttaccgttgaagatggagtgtttatggacatggaagattccaagaatatgctagaagcacaggttccagtggtgtcatcagaatttgaagacatgcatcatttgcttctaagtattgccaatgagcctttacgttcagctcctccttccccaacaaattatggtagttataactggggtgacatggagatttttgatactcaattagtttcactttggaacttctctatttgatactcttcttggatgtggttgattttgtaaaacttattttttagttcagtttgaaatgaagtcacattt

SEQ ID NO: 1744 - protein, 229 aa, Medicago truncatula
  G3368,AP2 domain coordinates 51-120
MDFFMSSFSDYSDTSSSETASSNRTSSSEVILAPARPKKRAGRRVFKETRHPVYRGVRRRKNNKWVCEMRVPNNIVNKNNKSRIWLGTYPTPEMAARAHDVAALTLKGKSACLNFADSAWRLRLPESNDATEIRRAAMEAAQLFAVEDKQCCVTVEDGVFMDMEDSKNMLEAQVPVVSSEFEDMHHLLLSIANEPLRSAPPSPTNYGSYNWGDMEIFDTQLVSLWNFSI

SEQ ID NO: 1745 - DNA, 1270 bp, Medicago truncatula
  G3369,family:AP2
actcacagtttaactgtttacttcatttttccttcaaactatgcttccttataaatataccacctttctcttggttttcttaaatctcaacaccaaaatttcaacctctttactctataacaaactcttatcttcaattctagatttcactatcaaaacctttttctactatctccagcacatggatatgtttacaaataataactcctattcacaccccttttctccaacttgctccgagagttcattcccgaattcagagggctcgcaagggatgtcaatttccaacgaggaggtgaggttagcagcgactactccaaagaagcgtgcagggaggaagaagttcaaggagactcgccacccggtatataggggtgtgaggaaaagaaacttagataaatgggtgtgtgaaatgagggaaccaaataagaagactaaaatttggctaggcacttttccaactgcggagatggcagcccgagcacatgatgttgccgcaatggcattgaggggccgctacgcctgtctcaactttgcagactccgcgtggcggctccctatacctgccaccactcaggcaaaagatatacaaaaggcggctgcacaggccgctgaggctttcagaccagacaagacttcaattactaatgacattgacacggctatttccacctctgctacggcggaacagagtaggacttttatggaagaggaagaagagggggtgatgaacatgccagagttgttgaggaatatggcactaatgtctcctacacatagctctgggtataatgaatatgaaaatattcatgttcaagactttcaagatttacaagattttcaagatgaagaggtatcactgtggaatttttaatttttaattttcttttgatgaatagctttattatatatggtgtgttggtttattattttttatctctgaattgtagaacagaactttctgttctacaaccatttttattagtagtactgattcttcatatatacatatgttgaaattgaaaagcaaattctttttgcattcttttctgtaatgcaggtattaatcaagcataaagtgcttctcatcccttctattagtatatatgaaagaagaatagaagtttggtatgtcaaaatcagtgtcaacttcattagctatttaaattaagttaaaggaggtaattaaaatctgtgtctctcttctttttcttctcttatattatcatttgtaggattttaaaaaatagtttgtaaccgtaatttgggt

SEQ ID NO: 1746 - protein, 277 aa, Medicago truncatula
  G3369,AP2 domain coordinates 107-170
MLPYKYTTFLLVFLNLNTKISTSLLYNKLLSSILDFTIKTFFYYLQHMDMFTNNNSYSHPFSPTCSESSFPNSEGSQGMSISNEEVRLAATTPKKRAGRKKFKETRHPVYRGVRKRNLDKWVCEMREPNKKTKIWLGTFPTAEMAARAHDVAAMALRGRYACLNFADSAWRLPIPATTQAKDIQKAAAQAAEAFRPDKTSITNDIDTAISTSATAEQSRTFMEEEEEGVMNMPELLRNMALMSPTHSSGYNEYENIHVQDFQDLQDFQDEEVSLWNF

SEQ ID NO: 1747 - DNA, 845 bp, Oryza sativa (indica cultivar-group)
  G3370,family:AP2
tccaactccaagtctccaacctcagctcagctcaagctcgccggcgaagtgaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggcgcaggggctgctcgtcgagccgccggccgccggagcgtggtgggaggacggcgagctcgccggctccgatatgccgctctggagctactaatcaaaatctcgcactgaaaagtgtggacaaattttgattctccagaaattgggggaaaaaagagaacagagtattggtgaatttagaacagagtaggcaatgagactgaggatgaatgg

SEQ ID NO: 1748 - protein, 218 aa, Oryza sativa (indica cultivar-group)
  G3370,AP2 domain coordinates 29-99
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 1749 - DNA, 1103 bp, Oryza sativa (indica cultivar-group)
  G3371,family:AP2
ccatcaacaccgagatcgactcgacgcctctaccatcaagtcgctgccgtcggtgatgacggtgcgcagctgtggccaacgggggaggcagaggaggtacgcacggatgccctcgcccccgtcgtcgccgccgccaacactaaccaactgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaacgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaaccgcctggcgacgtcctctcacctcagtcctccctcccagtgagcgaacaatgag

SEQ ID NO: 1750 - protein, 253 aa, Oryza sativa (indica cultivar-group)
  G3371,AP2 domain coordinates 36-102
MEKNTAASGQLMTSSAEATPSSPKRPAGRTKFQETRHLVFRGVRWRGCAGRWVCKVRVPGSRGDRFWIGTSDTAEETARTHDAAMLALCGASASLNFADSAWLLHVPRAPVVSGLRPPAARCATRCLQGHRRVPAPGRGSNATATATSGDAASTAPPSAPVLSAKQCEFIFLSSLDCWMLMSKLISSSRAKGSLCLRKNPISFCMVTNSYTALLLEYIILQMNSMIVLIHELSKYQVFLLLTMITHHLFQWRR

SEQ ID NO: 1751 - DNA, 698 bp, Oryza sativa (japonica cultivar-group)
  G3372,family:AP2
ccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttt

SEQ ID NO: 1752 - protein, 214 aa, Oryza sativa (japonica cultivar-group)
  G3372,AP2 domain coordinates 30-95
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 1753 - DNA, 813 bp, Oryza sativa (japonica cultivar-group)
  G3373,family:AP2
cactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacgg

SEQ ID NO: 1754 - protein, 219 aa, Oryza sativa (japonica cultivar-group)
  G3373,AP2 domain coordinates 43-109
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 1755 - DNA, 892 bp, Oryza sativa (indica cultivar-group)
  G3374,family:AP2
accacaaacacctccatcaccaccaccacggcaccaccacctccaaattccaatgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcgggagtcatcatcgtccgtgttcccactcgccatcgacgtcgtcgccgaggacgccatgtccgccacgtccgagccgtccgccgcgagcgacgacgacgccgtcaccagcagcagcagcacgaccgacgccgacgaggaggcatcaccgttcgagctggatgtggtgagcgacatgggctggagcctgtactacgcgagcttagcggagggcctcctcatggagccgccggcttccggcgcatcgtccgacgacgacgacgacgccatcgtcgactcaggcgacatcgctgacgtgtctctgtggagctactagcattgaagcagacgcgcgtcatgctcttgtacataaaagagtgacttcctaattaacagcagctgagcatgtatggccttgtat

SEQ ID NO: 1756 - protein, 251 aa, Oryza sativa (indica cultivar-group)
  G3374,AP2 domain coordinates 51-118
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSGDIADVSLWSY

SEQ ID NO: 1757 - DNA, 765 bp, Oryza sativa (japonica cultivar-group)
  G3375,family:AP2
ctttcctcccaaatcaagaccaaatcggataatttcaaatccttgtcgagtgaactgatccatcgatggagtgggcgtactacggcagtgggtactcctcgtcggggacgccgtcgccggtgggcggcgacggggacgaggactcgtacatgacggtgtcgtcggcgccgcccaagcggcgggcggggaggaccaagttcaaggagacgaggcacccggtgtacaagggcgtgcgcagcaggaaccccgggaggtgggtctgcgaggtgcgcgagccgcacggcaagcagaggatctggctcggcaccttcgagaccgccgagatggcggcgcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagc

SEQ ID NO: 1758 - protein, 219 aa, Oryza sativa (japonica cultivar-group)
  G3375,AP2 domain coordinates 49-113
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 1759 - DNA, 759 bp, Oryza sativa (indica cultivar-group)
  G3376,family:AP2
atcaacctcgctcgcttactcgtgtttaggcatggacgtttctgctgcgctcagcagcgactactcgtcggggacgccgtcgccggtggcggccgacgctgacgacggctcctccgcctacatgacggtgtcgtcggcgccgcccaagcggcgggcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctacctcgacatggcgcaagggatgctcattgacccgcctccaatggcctgtgatcctgccgtaggtggcggcgaagacgacaacgatggcgaggtccagctatggagctactgatcctgcgcgtttgaactcaacttggtttggcgcgaagagatcgcatgtacagc

SEQ ID NO: 1760 - protein, 224 aa, Oryza sativa (indica cultivar-group)
  G3376,AP2 domain coordinates 51-115
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 1761 - DNA, 847 bp, Oryza sativa (japonica cultivar-group)
  G3377,family:AP2
cgccgccaacaccaaccaactgcggcttgagacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctagcatcaaattaaccaaacaatcttcactagcttgttggatgtagtagtagcagttctagctagcacaagtgcagaacacaaaaggatcgttt

SEQ ID NO: 1762 - protein, 236 aa, Oryza sativa (japonica cultivar-group)
  G3377,AP2 domain coordinates 41-107
MEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 1763 - DNA, 949 bp, Oryza sativa (indica cultivar-group)
  G3378,family:AP2
gttgtcaccagctgttctctcccatggcttccctgcgtcccaaccctcgccgcccaaatgcatacctatatatatactcctcgcgccgccgagctcgagcactctcactctgcaagcgcgacgcgttctcactcgctcggacaagctcctccatctctcgatcgctcacgagcagcaatggacatggccggccacgaggtgaactccagctcgtcgtcgtcgggggcggagtcgtcgtcgtcctcgtcggggcggcagcagtacaagaagcggcccgcggggcgcaccaagttcagggagacgcggcacccggtgtaccgcggcgtgcggcgccgcggcggggcggggcggtgggtgtgcgaggtgcgcgtcccggggaagcgcggcgcgcgcctgtggctcggcacgtacgtcaccgccgaggccgcggcgcgcgcgcacgacgccgccatgatcgcgctccgcggcggcgccggcggaggcggcgcggcgtgcctcaacttccaggactccgcgtggctgctcgccgtcccgcccgccgcgccgtccgacctggccggcgtccgccgcgcggccaccgaggccgtcgcgggcttcctccagcgcaacaagaccacgaacggcgcctccgtcgcggaggccatagacgaggccacctccggcgtgtccaagccgccgccgctggccaacaatgccgactcatcggagacgcccggaccttcatcgatcgacggaacggctgacacggcggcgggggcggcgctggacatgttcgagctcgacttcttcggcgaaatggactacgacacgtactacgcgagcctggccgaggggcttctcatggagccgccgccggcggcgaccgcactctgggacaacggcgacgaaggcgctgacatcgcgctctggagctactgagctctgacactgtctccagttgactgtactc

SEQ ID NO: 1764 - protein, 286 aa, Oryza sativa (indica cultivar-group)
  G3378,AP2 domain coordinates 83-154
MHTYIYTPRAAELEHSHSASATRSHSLGQAPPSLDRSRAAMDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAIDEATSGVSKPPPLANNADSSETPGPSSIDGTADTAAGAALDMFELDFFGEMDYDTYYASLAEGLLMEPPPAATALWDNGDEGADIALWSY

SEQ ID NO: 1765 - DNA, 895 bp, Oryza sativa (japonica cultivar-group)
  G3379,family:AP2
cactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtccaccccacgcaccgacgacgacgaggagtccgccgccaccgacggcgacgagtcctcctccccggccagcgacctggcgttcgaactggacgtcctgagtgacatgggctgggacctgtactacgcgagcttggcgcaggggatgctcatggagccaccatcggcggcgctcggcgacgacggtgacgccatcctcgccgacgtcccactctggagctactagagctcaatcaactgtacaattttgcctcttttttctctcttttctggcttccgatgccaaaattttggtactgtacggacactactttcggtaatgtgatggaacaagttgc

SEQ ID NO: 1766 - protein, 238 aa, Oryza sativa (japonica cultivar-group)
  G3379,AP2 domain coordinates 47-119
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 1767 - DNA, 579 bp, Oryza sativa (japonica cultivar-group)
  G3380,family:AP2
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 1768 - protein, 136 aa, Oryza sativa (japonica cultivar-group)
  G3380,AP2 domain coordinates 18-82
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 1769 - DNA, 514 bp, Oryza sativa (japonica cultivar-group)
  G3381,family:AP2
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 1770 - protein, 131 aa, Oryza sativa (japonica cultivar-group)
  G3381,AP2 domain coordinates 14-78
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 1771 - DNA, 375 bp, Oryza sativa (japonica cultivar-group)
  G3383,family:AP2
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 1772 - protein, 124 aa, Oryza sativa (japonica cultivar-group)
  G3383,AP2 domain coordinates 9-73
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 1773 - DNA, 966 bp, Oryza sativa (japonica cultivar-group)
  G3384,family:MYB-(R1)R2R3
atggggaggccgccgtgctgcgacaaggtcggggtgaagaaggggccatggacgccggaggaggacctgatgctggtctcctacatccaggagcacggcgccggcaactggcgcgccgtgccgacgaacaccgggctgatgcgttgcagcaagagctgccggctccggtggacgaactacctcaggccggggatcaagcgggggaacttcaccgagcaggaggagaagctcatcgtccacctccaggctctcctcggcaaccggtgggcagcgatagcgtcgtacttgccggagaggacggacaacgacatcaagaactactggaacacgcacctcaagaagaagctcaagaagatgcaggccgccggaggtggggaagacagcggcgccgcctcggagggtggcggcggccgcggcgacggcgacggcggcgggaaaagcgtgaaggccgccgcacctaaggggcagtgggagcggcggctgcagacggacatccacacggcgcggcaggcgctgcgcgacgcgctctcgctcgaccaccccgacccgtcgccggcgacggcggcggcggcggcgacgccagcggggtcgtcggcggcgtacgcgtcgagcgcggacaacatcgcgcggctgctgcagggctggatgcgcccgggcggcggcggcggcggcaacggcaagggccccgaggcgtcggggtcgacctccacgacggcgacgacgcagcagcagccgcagtgctccggcgagggcgcggcatccgcgtccgcgtcggcgagccagagcggcgccgccgccgcggcgactgcccagacgccggagtgctcgacggagacgagcaagatggccaccggcggcggcgccggcggccccgcgccggcgttctcgatgctggagagctggctgctcgacgacggcggcatggggctcatggacgtggtgccattgggggaccccagtgagtaa

SEQ ID NO: 1774 - protein, 321 aa, Oryza sativa (japonica cultivar-group)
  G3384,MYB-(R1)R2R3 domain coordinates 14-118
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAGGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSE

SEQ ID NO: 1775 - DNA, 924 bp, Oryza sativa (japonica cultivar-group)
  G3385,family:MYB-(R1)R2R3
atggggcggccgccgtgttgcgagaaggagggggtgaagaaggggccatggacgccggaggaggacatggtgctggcgtcgtacgtgcaggagcacggcccgggcaactggcgcgccgtgccgcccaggacgggcctcctccgctgcagcaagagctgccgcctccgctggaccaactacctccgcccgggcatccgccgcggcggcttctcccaccacgaggagcgcctcatcctccacctccaggccctcctcggcaaccgctgggccgccatcgcctcctacctcccccaccgcaccgacaacgacgtcaagaacttctggaacacccacctcaagaagaagctcgccctcacctcctcctcctcctcgccgccgacgccgacgacgccgctcgtcgccagggggcagtgggagcgcaagctgcagaccgacatcgacctcgccaggcgcgccctccgcgacgccctctccgtcgacgacgccgcctccccggcgatgatcagcagcgggccgcccgcgccggcggcggcggcggcgtacgccctgagcgagcgcaacatctccgtgatgctgagcggctgggcggcgccgcctccggccaggaaaggattgtcagcctgcaacccggcggcggcgacgacgacgcccggtggcgccgccgcggagagcgcgtccacggccgggacgtcgttggagctcaccgccgactgctgctccggcggcggcgactccagcgcgtccaactgcctgccgtcgtccatgctcctcgcgtgcgacgacggcgacgcgacggcgacggcggccggggtggcgccgctgtcggcgatcgagtcgtggctgctgctcgacgacagcggagagccgcagctggcactggacgagcagctgctggacgtagctctccgtaattacgctttctaa

SEQ ID NO: 1776 - protein, 307 aa, Oryza sativa (japonica cultivar-group)
  G3385,MYB-(R1)R2R3 domain coordinates 14-118
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 1777 - DNA, 1026 bp, Oryza sativa (japonica cultivar-group)
  G3386,family:MYB-(R1)R2R3
atggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaa

SEQ ID NO: 1778 - protein, 341 aa, Oryza sativa (japonica cultivar-group)
  G3386,MYB-(R1)R2R3 domain coordinates 14-118
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 1779 - DNA, 1291 bp, Oryza sativa (japonica cultivar-group)
  G3388,family:AP2
ctagacactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgag

SEQ ID NO: 1780 - protein, 365 aa, Oryza sativa (japonica cultivar-group)
  G3388,AP2 domain coordinates 66-129,181-274
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1781 - DNA, 1068 bp, Oryza sativa (japonica cultivar-group)
  G3389,family:AP2
gctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagc

SEQ ID NO: 1782 - protein, 317 aa, Oryza sativa (japonica cultivar-group)
  G3389,AP2 domain coordinates 64-129,177-266
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 1783 - DNA, 1348 bp, Oryza sativa (japonica cultivar-group)
  G3390,family:AP2
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 1784 - protein, 394 aa, Oryza sativa (japonica cultivar-group)
  G3390,AP2 domain coordinates 66-131,192-294
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 1785 - DNA, 1338 bp, Oryza sativa (japonica cultivar-group)
  G3391,family:AP2
ggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatagagttagcactattagctcgatcttctctagctagtgtcttttttgctcccatgcatcataattcaggtggtagctagcttagtcccttgttgatcctatctactaatctcacttggttttttttgttaatttattcgcccatgttcttgcttgctttgctgta

SEQ ID NO: 1786 - protein, 378 aa, Oryza sativa (japonica cultivar-group)
  G3391,AP2 domain coordinates 79-148,215-300
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHADGKLFIDCKLVRSTGAALASPADQPAPSPVKAVRLFGVDLLTAPAPVEQMAGCKRARDLAATTPPQAAAFKKQCIELALV

SEQ ID NO: 1787 - DNA, 321 bp, Oryza sativa (japonica cultivar-group)
  G3392,family:MYB-related
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 1788 - protein, 79 aa, Oryza sativa (japonica cultivar-group)
  G3392,MYB-related domain coordinates 32-76
MESSGGSQLGKNSKTSDGRETKEVNSTAQNFVHFTEEEEDIVFRMHRLVGNRWELIAGRIPGRTAEEVEKFWAIKHQAT

SEQ ID NO: 1789 - DNA, 356 bp, Oryza sativa (japonica cultivar-group)
  G3393,family:MYB-related
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 1790 - protein, 78 aa, Oryza sativa (japonica cultivar-group)
  G3393,MYB-related domain coordinates 31-75
MDSSSGSQGKNSKTSDGCETKEVNNTAQNFVHFTEEEEDLVFRMHRLVGNRWELIAGRIPGRTAKEVEMFWAVKHQNT

SEQ ID NO: 1791 - DNA, 1231 bp, Oryza sativa (indica cultivar-group)
  G3394,family:CAAT
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 1792 - protein, 185 aa, Oryza sativa (indica cultivar-group)
  G3394,CAAT domain coordinates 38-126
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 1793 - DNA, 610 bp, Oryza sativa (japonica cultivar-group)
  G3395,family:CAAT
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 1794 - protein, 164 aa, Oryza sativa (japonica cultivar-group)
  G3395,CAAT domain coordinates 19-108
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 1795 - DNA, 837 bp, Oryza sativa (japonica cultivar-group)
  G3396,family:CAAT
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 1796 - protein, 143 aa, Oryza sativa (japonica cultivar-group)
  G3396,CAAT domain coordinates 21-110
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 1797 - DNA, 720 bp, Oryza sativa (japonica cultivar-group)
  G3397,family:CAAT
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 1798 - protein, 219 aa, Oryza sativa (japonica cultivar-group)
  G3397,CAAT domain coordinates 23-112
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 1799 - DNA, 761 bp, Oryza sativa (japonica cultivar-group)
  G3398,family:CAAT
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 1800 - protein, 224 aa, Oryza sativa (japonica cultivar-group)
  G3398,CAAT domain coordinates 21-110
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 1801 - DNA, 1160 bp, Oryza sativa (japonica cultivar-group)
  G3399,family:AT-hook
cggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcaggc

SEQ ID NO: 1802 - protein, 336 aa, Oryza sativa (japonica cultivar-group)
  G3399,AT-hook domain coordinates 99-107,108-253
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1803 - DNA, 1143 bp, Oryza sativa (japonica cultivar-group)
  G3400,family:AT-hook
ctctgcaggtgaggtgaggtgaggggtgggatcgagggatcgagaagctggcggcgagcaagtggtgggagcgcgccgatgagggcgccatggccgggatggatcccaccggcggcggtggcggcggcggcgtggcggcgcactacctacacatgctccgcgcgcagcagcaccagccactgtccccggcaggtgacgtcaaggcggagcggtccatgctgtcgccggatgagagccccggcgcggacgccgacctaggatcggaccacccgacgtcgtcggccatggtggcggcggaggacagcggcggcggcagcggttcgggtggcccgatgcggcgcccccgcgggaggccgctgggctccaagaacaagcccaagccgcccatcatcgtgacgcgggacagccccaacgcgttccactcccacgtcctcgaggtcgccgcgggaaccgacatcgtcgagtgcgtctgcgagttcgcgcgccgccgcggccgcggcgtctccgtgctcagcggtggcggcgccgtcgccaacgtcgcgctccgccagccaggcgcgtcgcccccgggcagcctggtcgccaccatgcgcggccagttcgagatcctgtccctcacgggcaccgtcctcccgccgcccgcgccgcccagcgccagcggcctcaccgtcttcctctccggcgggcagggccaggtggtcggcgggagcgtggccggccagctcatcgccgcggggccagtcttcctcatggccgcctcgttcgccaatgccgtctacgagcgtctgccactcgatggggaggatccggaggcagaggctgccgccgccacccctcccggcgatgcggcgcagccaaccggcccaccaccaccgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctg

SEQ ID NO: 1804 - protein, 322 aa, Oryza sativa (japonica cultivar-group)
  G3400,AT-hook domain coordinates 83-91,92-237
MAGMDPTGGGGGGGVAAHYLHMLRAQQHQPLSPAGDVKAERSMLSPDESPGADADLGSDHPTSSAMVAAEDSGGGSGSGGPMRRPRGRPLGSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDGEDPEAEAAAATPPGDAAQPTGPPPPQQQPTASQSSEVTAGDGGGGGGLGMYLGGHVGSYQQQQQQLPGPGDNFGSWSGSIRPPPF

SEQ ID NO: 1805 - DNA, 918 bp, Oryza sativa (japonica cultivar-group)
  G3406,family:AT-hook
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 1806 - protein, 305 aa, Oryza sativa (japonica cultivar-group)
  G3406,AT-hook domain coordinates 82-90,91-232
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 1807 - DNA, 987 bp, Oryza sativa (japonica cultivar-group)
  G3407,family:AT-hook
tcatcatcatcatcacttgcatatcgaattattaataatatcgaagatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgcgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatgg

SEQ ID NO: 1808 - protein, 289 aa, Oryza sativa (japonica cultivar-group)
  G3407,AT-hook domain coordinates 63-71,72-220
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 1809 - DNA, 920 bp, Oryza sativa (japonica cultivar-group)
  G3429,family:CAAT
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 1810 - protein, 193 aa, Oryza sativa (japonica cultivar-group)
  G3429,CAAT domain coordinates 40-124
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 1811 - DNA, 959 bp, Oryza sativa (japonica cultivar-group)
  G3430,family:AP2
ccaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcccgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtg

SEQ ID NO: 1812 - protein, 303 aa, Oryza sativa (japonica cultivar-group)
  G3430,AP2 domain coordinates 145-209
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 1813 - DNA, 257 bp, Zea mays
  G3431,family:MYB-related
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 1814 - protein, 78 aa, Zea mays
  G3431,MYB-related domain coordinates 31-75
MDSSSGSQDKKFRDNDRPEAKEANSTAQHLVDFTEAEEDLVSRMHRLVGNRWEIIAGRIPGRTAEEVEMFWSKKYQER

SEQ ID NO: 1815 - DNA, 1290 bp, Zea mays
  G3432,family:AP2
ctatagctagcactagcagtggtgcacactgaaatggacagcgccagcagcctcgtggacgacaccagtagcggtggcggcggcggcgcgtccacggacaagctaagggctctggccgtcttcgccgccgcctcggggacgccgctggagcgcatgggcagcggcgccagcgcggtcgtggacgcggccgagccgggcgccgaggcggactccggttccggtgccgccgcggtgagcgtcggcgggaagctgccgtcgtcaaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgccgccgccgagctccggttcctggcgtcccgctccaaggccgaggtcgtcgacatgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtgtagattaatgctacggagcgatcgatctttccctggctagctagtcttttttttttttgctcgatcgctcaactcagatggtagcatcat

SEQ ID NO: 1816 - protein, 389 aa, Zea mays
  G3432,AP2 domain coordinates 75-140,212-299
MDSASSLVDDTSSGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASASAATASSLANNPSSYASLSPATATAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVVASTAGPSPPAPVAKAVRLFGVDLLTAPATAAAPAEAVAGCKRARDLGSPPQAAFKKQLVELALV

SEQ ID NO: 1817 - DNA, 1437 bp, Zea mays
  G3433,family:AP2
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcacgggcgaggccgaggccgcgcgcgcctacgacgtggccgcgcagcggttccgggggcgcgacgccgtcaccaacttccgcccgctcgcggagtcggacttggacccggacgccgccgccgagctccggttcctcgcgtcccggtccaaggccgaggtcgtcgacatgctccgcaagcacacctacggcgaggagctcgcgcagaacaggcgcgccttcgccgctgcggcggcgtccctggcctcgccgcagctgccgccggccaagaacactagcccggcggcggcgcgcgagcacatgttcgacaaggtgctgaccccgagcgacgtaggcaagctcaaccggctggtggtgccaaagcagcacgcggagcggttcttcccggcggccggcgccgggtcgacgcagctgtgcttccaggaccgcggcggggcgctgtggcagttccgctactcctactgggggagcagccagagctatgtcatgaccaaggggtggagccgcttcgtccgcgccgcacgacttgccgcgggggacaccgtcaccttctcccgcagcggcggcggccgatacttcatcgagtaccgccactgccagcgccggcgccgcgacgtcgatatcagcttcggcgacgctgccaccgtgccggcgtggccgaggccgatagttatcggaaccgcggccatgaataatgggggtgcaacggtggcgtccgccaccatcgccggccatgacatcgaggtggcagtggcaccctcgggggcgaggagcttcaggctcttcgggttcaatgttgagtgcagcggcgacgatgcaccggcaccggcacctgctcccgccgaagtggagtatgtcgacggcgacacctagtagcagcggcggcgtagagtgcgcagagagacgatgaacgatggtgatctactgatcagggaccttattacaccataggtggcgtgcatgccttgttgaatcttaattagtcatgtttttcgaaaaaaaa

SEQ ID NO: 1818 - protein, 399 aa, Zea mays
  G3433,AP2 domain coordinates 80-151,210-291
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHMFDKVLTPSDVGKLNRLVVPKQHAERFFPAAGAGSTQLCFQDRGGALWQFRYSYWGSSQSYVMTKGWSRFVRAARLAAGDTVTFSRSGGGRYFIEYRHCQRRRRDVDISFGDAATVPAWPRPIVIGTAAMNNGGATVASATIAGHDIEVAVAPSGARSFRLFGFNVECSGDDAPAPAPAPAEVEYVDGDT

SEQ ID NO: 1819 - DNA, 819 bp, Zea mays
  G3434,family:CAAT
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaacaaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaaaaaaaaaaaaaaaa

SEQ ID NO: 1820 - protein, 164 aa, Zea mays
  G3434,CAAT domain coordinates 18-107
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 1821 - DNA, 735 bp, Zea mays
  G3435,family:CAAT
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 1822 - protein, 222 aa, Zea mays
  G3435,CAAT domain coordinates 22-111
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 1823 - DNA, 803 bp, Zea mays
  G3436,family:CAAT
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 1824 - protein, 212 aa, Zea mays
  G3436,CAAT domain coordinates 20-109
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 1825 - DNA, 1322 bp, Zea mays
  G3437,family:CAAT
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 1826 - protein, 246 aa, Zea mays
  G3437,CAAT domain coordinates 54-143
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 1827 - DNA, 994 bp, Zea mays
  G3438,family:AP2
ccacgcgccccctcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgccgccgccaccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaactccaaaaaaaaaaaaaaaaaaaaaaaaag

SEQ ID NO: 1828 - protein, 246 aa, Zea mays
  G3438,AP2 domain coordinates 50-116
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 1829 - DNA, 1002 bp, Zea mays
  G3439,family:AP2
tcgcgatctagaactagtctcagctcaatcccgagacaaaggagccctcctccacctccactcccagcagcaagctcaagcaagcagccaccacaccaccagcagtgaacagcggcagccatggacatgggccggctccagctccagctccagcacgcggcctcctcgtcctccacctcggcgtcgtcctcgtcctcgtccgagcagaacaagctggcctggtccccgtcctccccgcagccgcccaagaagcgccccgcggggcgcaccaagttccgggagacgcggcacccggtgttccgcggcgtgcggcggcggggcgccgcgggccggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgccgcctgcctcaacttccccgactccgcgtggctgctcgccgtgccgcccccgcccgcgctctcgggcggcctggacggcgcccgccgggccgcgctcgaggccgtcgcggagttccagcgacgccgcttcggggcggtagccgccgacgaagcgacctcgggcacgtctcctccctcctcctcctcgtcgccgtcgggcacttatgtctcgcaggcgccggcgccggcgattgagcgcgtgcctgtggaggccagtgagacggcggcgttggacggcgccgtgttcgagcccgactggttccgggacatggacttggacttgtactatgccagcctcgcggaagggctgctcgtggagccgccgccaccgcccgccgcctgggatcatggtgactgctcccactccggagctgacgtcgcgctctggagctactagcaagctatagcagcaataagcttggcaatgccaccaactcatctgtactgtactgtacttgtaccctgtaccaaaatccaaattgatttccagcaaattaacttaccaatc

SEQ ID NO: 1830 - protein, 256 aa, Zea mays
  G3439,AP2 domain coordinates 57-126
MDMGRLQLQLQHAASSSSTSASSSSSSEQNKLAWSPSSPQPPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAVAADEATSGTSPPSSSSSPSGTYVSQAPAPAIERVPVEASETAALDGAVFEPDWFRDMDLDLYYASLAEGLLVEPPPPPAAWDHGDCSHSGADVALWSY

SEQ ID NO: 1831 - DNA, 976 bp, Zea mays
  G3440,family:AP2
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaatgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 1832 - protein, 231 aa, Zea mays
  G3440,AP2 domain coordinates 49-116
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVDDFLRHQLVPEDDALAATPSSPSSEDGNTSDGGESSSDSSPPTGASPFEFDVFNDMSWDLHYASLAQGLLVEPPSAVTAFMDEGFADVPLWSY

SEQ ID NO: 1833 - DNA, 798 bp, Zea mays
  G3441,family:AP2
cagccatcgcgttccgcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgcggcggcgatgtacggcggcggcatggagttcgaccactcgtattgctacgacgacgggatggtgagcgggagcagcgactgctggcaaagcggcgccggcgccggcggatggcatagcatcgtggacggcgacgacgacgacggcgccagcgacatgacgctctggagctactgagctgtagagtctgtctccagcgcaggaggtt

SEQ ID NO: 1834 - protein, 232 aa, Zea mays
  G3441,AP2 domain coordinates 55-120
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAMYGGGMEFDHSYCYDDGMVSGSSDCWQSGAGAGGWHSIVDGDDDDGASDMTLWSY

SEQ ID NO: 1835 - DNA, 1085 bp, Zea mays
  G3442,family:AP2
gctcaagctcgagacaagaaaccagaaccagctcactcctcactccacttccactcccaacagcaagctcaagcagtcagtcaccggcaggggtcagggtcacagtcacagcagcagccatggacacggccggcctcgtccagcacgcgacctcctcgtcttccacctccacctcggcgtcgtcgtcctcgtccgagcagcagagccgcaaggcggcgtggccgccgtcgaccgcttcctcaccacagcagccgcccaagaagcgccccgcggggcgcacaaagttccgggagacgcggcacccggtgttccgcggcgtgcggcggcggggcgccgcgggccggtgggtgtgcgaggtgcgcgtcccggggaggcgcggcgcgcggctgtggctcggcacctacctcgccgccgaggcggcggcgcgcgcgcacgacgccgcgatactcgccctgcagggccgcggcgcggggcgcctcaacttcccggactccgcgcggctgctcgccgtgccgcccccgtccgcgctcccgggcctggacgacgcccgccgcgcggcgctcgaggccgtcgcggagttccagcgccgctctgggtccgggtccggggccgccgacgaagcgacctcgggcgcgtctcctccctcctcgtcgccgtcgctgccggacgtttctgcggctggctcgccggcggcggcgcttgagcacgtgcctgtgaaggccgacgaagcagtggcgttggacttggacggcgacgtgttcgggcccgactggttcggggacatgggcctggagttggatgcgtactacgccagcctcgcggaagggttgctcgtggagccgccgccgccgccggcggcctgggatcatggagactgctgtgactccggagctgcggacgtcgcgctctggagctactactagcaaagttaacaataataagcttgacagccaaccccaaaagccccccaactgattgtattcacctctgtaacaaaattcaaattgatttcccagcaaatgaacttcaaaagaagtctttggttccgatttaaaaaaaaaaaaaaaaaaaaaaaaaaaaaaaaa

SEQ ID NO: 1836 - protein, 267 aa, Zea mays
  G3442,AP2 domain coordinates 61-127
MDTAGLVQHATSSSSTSTSASSSSSEQQSRKAAWPPSTASSPQQPPKKRPAGRTKFRETRHPVFRGVRRRGAAGRWVCEVRVPGRRGARLWLGTYLAAEAAARAHDAAILALQGRGAGRLNFPDSARLLAVPPPSALPGLDDARRAALEAVAEFQRRSGSGSGAADEATSGASPPSSSPSLPDVSAAGSPAAALEHVPVKADEAVALDLDGDVFGPDWFGDMGLELDAYYASLAEGLLVEPPPPPAAWDHGDCCDSGAADVALWSYY

SEQ ID NO: 1837 - DNA, 726 bp, Zea mays
  G3443,family:AP2
tcgacaaagatgtgtccgaccaagaaggagatgagtgccgagtcgtcgggctcggcgagcagctggacttcggcctcggcctcggcctcgacctcgacctcgccggagcaccagaccgtgtggacgtcgccgccgaagcggcccgcggggcggaccaagttccgcgagacgcggcaccccgtgttccgtggcgtccggcgccgcggcagcgccgggcggtgggtgtgcgaggtgcgcgtgcccgggaggcgcgggtgcaggctctggctcggcacgttcgacgccgccgaggccgccgcgcgcgcgcacgacgccgccatgctcgccatcgccggcgcgagcgcgtgcctcaacttcgccgactccgcgtggctgctcgcggtccccgcctcgtacgccagccttgccgacgtccgccgtgcggtcgccgaggccgtggaggactttcagcgccgcgaggcggccgccggggacgacgcgcgctcggccacatcgccgacgccgtccacctcgggcaccgacgacgatgctgccactgacggcgaggagtcgtcaccggccacggaggtctcgtcgttccagctcgacgtgttcgataacatgagctgggatctatactacgcgagcatggcgcagggaatgctgatggagctgccgtccgcagttccggcgttcggagacgacggctacaccaatgtcgccgatgtgccactgtggagctactag

SEQ ID NO: 1838 - protein, 238 aa, Zea mays
  G3443,AP2 domain coordinates 49-112
MCPTKKEMSAESSGSASSWTSASASASTSTSPEHQTVWTSPPKRPAGRTKFRETRHPVFRGVRRRGSAGRWVCEVRVPGRRGCRLWLGTFDAAEAAARAHDAAMLAIAGASACLNFADSAWLLAVPASYASLADVRRAVAEAVEDFQRREAAAGDDARSATSPTPSTSGTDDDAATDGEESSPATEVSSFQLDVFDNMSWDLYYASMAQGMLMELPSAVPAFGDDGYTNVADVPLWSY

SEQ ID NO: 1839 - DNA, 268 bp, Zea mays
  G3444,family:MYB-related
cctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagattt

SEQ ID NO: 1840 - protein, 78 aa, Zea mays; identical to SEQ ID NO: 1814
  G3444,MYB-related domain coordinates 31-75

SEQ ID NO: 1841 - DNA, 302 bp, Glycine max
  G3445,family:MYB-related
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 1842 - protein, 73 aa, Glycine max
  G3445,MYB-related domain coordinates 25-69
MTDIDRSSDNVSSDSIEKSSQVSDVEFSEAEEILIAMVYNLVGERWSLIAGRIPGRTAEEIEKYWTSRFSTSQ

SEQ ID NO: 1843 - DNA, 257 bp, Glycine max
  G3446,family:MYB-related
gagaacttgttatgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 1844 - protein, 74 aa, Glycine max
  G3446,MYB-related domain coordinates 26-70
MADIDRSFDNNVSAVSTEKSSQVSDVEFSEAEEILIAMVYNLVGERWSLIAGRIPGRTAEEIEKYWTSRFSTSQ

SEQ ID NO: 1845 - DNA, 250 bp, Glycine max
  G3447,family:MYB-related
gttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 1846 - protein, 74 aa, Glycine max; identical to SEQ ID NO: 1844
  G3447,MYB-related domain coordinates 26-70

SEQ ID NO: 1847 - DNA, 264 bp, Glycine max
  G3448,family:MYB-related
attctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 1848 - protein, 75 aa, Glycine max
  G3448,MYB-related domain coordinates 26-70
MADSDLSSSQISTHSTDSGNRGSSKVEFSEDEETLIIRMYKLVGERWSIIAGRIPGRTAEEIEKYWTSRFSGSSE

SEQ ID NO: 1849 - DNA, 268 bp, Glycine max
  G3449,family:MYB-related
actcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 1850 - protein, 75 aa, Glycine max
  G3449,MYB-related domain coordinates 26-70
MADSDRSSSEVSTHSTDSGKRGSSKVEFSEDEETLIIRMYKLVGERWSLIAGRIPGRTAEEIEKYWTSRFSGSSE

SEQ ID NO: 1851 - DNA, 285 bp, Glycine max
  G3450,family:MYB-related
cagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 1852 - protein, 80 aa, Glycine max
  G3450,MYB-related domain coordinates 20-64
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 1853 - DNA, 1253 bp, Glycine max
  G3451,family:AP2
ctagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggc

SEQ ID NO: 1854 - protein, 401 aa, Glycine max
  G3451,AP2 domain coordinates 80-141,209-308
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 1855 - DNA, 1081 bp, Glycine max
  G3452,family:AP2
caccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtgc

SEQ ID NO: 1856 - protein, 351 aa, Glycine max
  G3452,AP2 domain coordinates 51-116,171-266
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1857 - DNA, 1442 bp, Glycine max
  G3453,family:AP2
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaaggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 1858 - protein, 362 aa, Glycine max
  G3453,AP2 domain coordinates 57-122,177-272
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 1859 - DNA, 1188 bp, Glycine max
  G3454,family:AP2
atggatgcaattagttgcatggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggactccgtcacgaacttcaagccgctcgccggcgccgacgacgacgacggagaatcggagtttctcaactcgcattccaaacccgagatcgtcgacatgctgcgaaagcacacgtacaatgacgagctggagcatagcaagcgcaaccgcggcgtcgtccggcggcgaggctccgccgccgtcggcaccgcagactcaatttccggcgcgtgctttactaatgcacgtgagcagctattcgagaaagctgttacgccgagcgacgtttggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaa

SEQ ID NO: 1860 - protein, 395 aa, Glycine max
  G3454,AP2 domain coordinates 74-141,203-302
MDAISCMDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDSVTNFKPLAGADDDDGESEFLNSHSKPEIVDMLRKHTYNDELEHSKRNRGVVRRRGSAAVGTADSISGACFTNAREQLFEKAVTPSDVWKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 1861 - DNA, 1301 bp, Glycine max
  G3455,family:AP2
tcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttttgagttttgtgactgatgaaagaaagaaggtacaagaagaacggcggtgtagtggcatagtggcatcgcaagttg

SEQ ID NO: 1862 - protein, 384 aa, Glycine max
  G3455,AP2 domain coordinates 74-143,201-300
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 1863 - DNA, 1283 bp, Glycine max
  G3457,family:AT-hook
atcatcaccaaatggtgctttgttcagctcaaattttggtggggttttgcaaaaaaccttaattcccttttctctttttccttttatgttgaagataactactaagtagcatgctcccaacacctcaaagtaaccaaaccaaaatcatcaccaccatctagatcccatattcccatctattaccctttcaatttgcttggacttttgtaggtgttcattgttcaaggcctccaaatctagggttgtgataaatggatcctgtagcagcacaaggacgtcctctccctccaccttttctcactagagatcttcacttacaccctcaccaccaattccagccccaccacaaccaccaaaacaccgaggatgaagccggcaatggccgcggccagaagcgagatcgcgacgagaacgccggcggcggaggcggggccaccacgcccccccagggcggcggggaaggcaaggaatccgggtcaggagatggaggagggagtgacatggggagaagaccaagaggaagacccgcagggtccaaaaacaagcccaaaccacccattatcatcacaagagacagtgccaacgctctccgatcccatgtcatggaaatcgccaacggctgcgacatcatggagagcatcaccgcctttgcaaggcggcgacagcgcggtgtctgcgtgctcagcggcagcggcactgtcaccaacgtcacgctccggcagccggcctcgccgggagcagttgtgacccttcatggaagatttgagattttgtccctgtccggttcttttctgccgccgccggccccacctgcggcgtcaggactagccatatatctggctggcggacagggacaggtagtaggtggaagtgtggtgggaccccttgtggcctcaggtcccgttgtcatcatggctgcttcatttggtaatgctgcttatgagagactgcccttagaggaagaggaaactccggtggcagttgctggcaacggaggattaggatccccaggaatcccaggaacccagcaacaaccgcaacagcaacagcaacaacaacttgtgggagatcctaatagttcttctcttttccatggaatgcctcagaatcttctcaattcagttcaattaccggctgagggttattggggtggaagtgctcgccctcccttttaacaaagtgttttactttcatggttttttccgttatctttgttttcttctttttcttattttatttttgtttatgtctctttttttttttttaatttcgactttctcttt

SEQ ID NO: 1864 - protein, 307 aa, Glycine max
  G3457,AT-hook domain coordinates 86-94,95-237
MDPVAAQGRPLPPPFLTRDLHLHPHHQFQPHHNHQNTEDEAGNGRGQKRDRDENAGGGGGATTPPQGGGEGKESGSGDGGGSDMGRRPRGRPAGSKNKPKPPIIITRDSANALRSHVMEIANGCDIMESITAFARRRQRGVCVLSGSGTVTNVTLRQPASPGAVVTLHGRFEILSLSGSFLPPPAPPAASGLAIYLAGGQGQVVGGSVVGPLVASGPVVIMAASFGNAAYERLPLEEEETPVAVAGNGGLGSPGIPGTQQQPQQQQQQQLVGDPNSSSLFHGMPQNLLNSVQLPAEGYWGGSARPPF

SEQ ID NO: 1865 - DNA, 1153 bp, Glycine max
  G3458,family:AT-hook
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtcctcagtgggagtggcaccgtgaccaacgtgacattgaggcagccggccgcggctggtgccgtcgtcacgctgcacggaaggtttgagatcctctctttgtcaggatcattcctcccacctccagctccaccaggtgctacaagtttgactgtgttccttggtggaggacagggtcaagtggtgggaggaaatgttgttggtcctttggtggcttctgggcctgttattgttattgcttcatcttttactaatgtagcatatgagaggttgcctttggatgaagatgaatctatgcagatgcaacaagggcaatcatcagctggtgatggtagcggtgaccatggtggtggagttagtaataactcttttccggatccgtcttccgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaaatcgtttgtttggctaggtttgttgtaaggacgatcagtttctaggaacaactgtaaaacgttttctctt

SEQ ID NO: 1866 - protein, 270 aa, Glycine max
  G3458,AT-hook domain coordinates 56-64,65-207
MAGIDLGSASHFVHHRLERPDLEDDENQQDQDNNLNNHEGLDLVTPNSGPGDVVGRRPRGRPPGSKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 1867 - DNA, 1596 bp, Glycine max
  G3459,family:AT-hook
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 1868 - protein, 295 aa, Glycine max
  G3459,AT-hook domain coordinates 77-85,86-228
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 1869 - DNA, 862 bp, Glycine max
  G3460,family:AT-hook
tatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcctggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggtaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacaacaacaacaacagcttcagattcagtcacccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagactga

SEQ ID NO: 1870 - protein, 276 aa, Glycine max
  G3460,AT-hook domain coordinates 74-82,83-225
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQQQQLQIQSPATTSSQGNNNNNPFPDPSSGLPFFNLPLNMQNVQLPPF

SEQ ID NO: 1871 - DNA, 936 bp, Glycine max
  G3461,family:AT-hook
ttcccttctaacctcccattccgttttctctgcagtactcaattgatccctttgtttttctattcgttctgagagctttgtgtgtatggccggcatagacttgggttcagcatcacattttgttcatcatcgccttcaacgccctgaccttgaagacgatgagaaccaacaagaccaagacaacaccgtgaccaacgtgacgttgagacagccagctgcggctggtgccgtcgtcacgctgcacggaaggtttgagatcctctctttgtcaggatcgttcctcccacctccagctccaccaggtgctacaagtttgactgtgttccttggtggaggacagggtcaagtggtgggaggaaatgttgttggtcctttggtggcttctgggcctgttattgttattgcttcatcttttactaatgtagcatatgagaggttgcctttggatgaagatgaatctatgcagatgcaacaagggcaatcatcagctggtgatggtagcggtgaccatggtggtggagttagtaataactcttttccggatccgtcttccgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaatcgttttgtttggctaggtttgttgtaaggacgatcagtttctaggaacaactgtaaaacgttttctcttggttgctggagttattagactagactgttgtgcattaaccttgagttgaataaatcataggctcaaatcaataaccaaaatatatattttggataattaaaaaaa

SEQ ID NO: 1872 - protein, 185 aa, Glycine max
  G3461,AT-hook domain coordinates NA
MAGIDLGSASHFVHHRLQRPDLEDDENQQDQDNTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 1873 - DNA, 1014 bp, Glycine max
  G3463,family:AP2
caacaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtgaagttagcagaagtgacgtcagctttgatgaagattccaatagcaacaaaggtttgagagttttttgtgatttggatgaaattacaatggcagatgcaccggtttttgaggacatgcgtgagtggcttcagagtatggcggatgagcctttaagatcgcctacttttgtaacatatgttaatgttagggatgtctggaactttgtggaggatgatgctgaggtatccttgtggagcttcacaatttagtgcgtttagtttgttctttgtcttctttcgtttttggtttttgtacataattaggaacggaggagtacgaaaatgtaccaagaccgagacgatataaggagctagctatatagggaggatcataaaactgtaagacattgcaaattttctcattcagttgtttttgtaattctcataatcatatagataaaggaaaggtttgtaaaataaaaaaaaaaaaaaaaaaaaagg

SEQ ID NO: 1874 - protein, 254 aa, Glycine max
  G3463,AP2 domain coordinates 60-125
MNILGQSFNESNNGSYSCSSPETGSSSNIPNTFHSDEEVHTLASARPKKRAGRRIFKETRHPVYRGVRRRNNNKWVCEVRVPNDKSTRIWLGTYPVPEMAARAHDVAALALRGKSACLNFADSAWRLPLPASTNAKEIRRVAAAAAVAIAAEDSCGEQLQNSIVNDAVADDCEVSRSDVSFDEDSNSNKGLRVFCDLDEITMADAPVFEDMREWLQSMADEPLRSPTFVTYVNVRDVWNFVEDDAEVSLWSFTI

SEQ ID NO: 1875 - DNA, 800 bp, Glycine max
  G3464,family:AP2
aattcggcaccaggttagttactactaactaccccttttgcacacgttgtctcattcactcaaacaacttcaaagaacgaagcttttcaccaagtaacatgttttccatcaatcatttctccgacccagatgccacctcgccggggtcgggaggaagctcccgaccggcgctgtcggacgaggatttttttctggcggcaagcaatcccaagaaacgcgccgggaggaagaagttccgggagacgcgccacccggtgtaccgcggcgtgagaaggcgggactccggcaagtgggtgtgcgaggtgcgcgagcccaacaagaagtccaggatttggctcgggacctttcccacggcggagatggcggcgcgtgcgcatgacgtggcggcgatcgcgctgaggggaaggtcagcctgcctcaacttcgccgactccgcgtctcggctcccggtgccggcgacggcggaggccagggacattcagaaggctgcggcggaggccgcagaggcgtttcgccctgggaaggatgatgatgcggtggcggagagggtggcagcgacggcgacggagcgtgaagaagaacaagaagaagggatggtgccggagtatctgaggaacatggtgctcatgtcgccgacgcattgcttcgggagtgatgagtatggaagtgctgacgtggaatttgacgatgctgaagtttctctgtggagttactccatttaatttaactcagttattggattttttttttactattttgagtaatgtaaagattgttcgtatgggacaagtagaatagtg

SEQ ID NO: 1876 - protein, 207 aa, Glycine max
  G3464,AP2 domain coordinates 50-114
MFSINHFSDPDATSPGSGGSSRPALSDEDFFLAASNPKKRAGRKKFRETRHPVYRGVRRRDSGKWVCEVREPNKKSRIWLGTFPTAEMAARAHDVAAIALRGRSACLNFADSASRLPVPATAEARDIQKAAAEAAEAFRPGKDDDAVAERVAATATEREEEQEEGMVPEYLRNMVLMSPTHCFGSDEYGSADVEFDDAEVSLWSYSI

SEQ ID NO: 1877 - DNA, 1252 bp, Glycine max
  G3465,family:AP2
ctcgacccactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaatcgttctttggagagtctgcaggccaatgtgcataggctcaaaacagg

SEQ ID NO: 1878 - protein, 234 aa, Glycine max
  G3465,AP2 domain coordinates 61-125
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 1879 - DNA, 1162 bp, Glycine max
  G3466,family:AP2
ccctcattcactctcttttctccggcagcaccaaaaccacccaacacttgaaatcaatatccattgttaccaaaaaagaaaagatcaaaacaccctttacatcattatactcagttccctctttccctatcaaaaccctttcccacaacactactcactctagtagtacaagcaaaaccttctaactttggcttcagcggcacatatatatatatatatgaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaagg

SEQ ID NO: 1880 - protein, 233 aa, Glycine max
  G3466,AP2 domain coordinates 63-127
MNMYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 1881 - DNA, 974 bp, Glycine max
  G3467,family:AP2
attcggctccggaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtatgtgattttctatatttttagggacctgttgtgtgtagataaattaagtagcactcgattgattaagttgagtggagttaaacatattgtagttgtatctatgatttgtttcgtgattaaattttaatgacaagtacagttggcaaattcaaaaaaaaa

SEQ ID NO: 1882 - protein, 226 aa, Glycine max
  G3467,AP2 domain coordinates 60-123
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIEQQQSVMATNDDEVQEPLQQEEVQDLHDLLLSIANEPLMSPPPCARDGRDWNDVDIFDDDEISLWNFSI

SEQ ID NO: 1883 - DNA, 1147 bp, Glycine max
  G3468,family:AP2
tcgactcgagccgaatcggctcgagccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatacattatcaaagaccctccctgttagcaatcctccaaaaaaaagagagagaaaaaaaaaaaaaaaaaaaaaaaaaaaagg

SEQ ID NO: 1884 - protein, 255 aa, Glycine max
  G3468,AP2 domain coordinates 63-128
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 1885 - DNA, 883 bp, Glycine max
  G3469,family:AP2
attcggctcgagtgggatttttagtccattgaattggatatatttatcctcatacatgatcttaggagacatttgtttttggtaaccactcgtcccaagcctaaataagttaaaacacagaagaaaatgcagaagcggagggcagggaggaagaagttccacgagacacgacacccggtgtacaagggagtgaggcagaggaacgggaagtgggtaagcgagctgcgacaacctaacaacaaaaacgcgcgggtgtggctcggaacattcgcgcaccccgacatggctgctatagcgtacgatgttgccgccttggctttcaagggcgacagtgcttccttaaacttcccgaacgccgccacctcgtttccccgccttaactcgcggacgtgttccgttagggccattcagtttgcggcgacgcaggcggcggagaagcatttttcttgtgtagagtctcaacaactccaaagggagggatcaggctccggaagcttctctttggacgatgattcttcggagttttcgtcccaaggaaggttcttttgggatgaagaggaagtgtttaacatgccggagttgctgaactgcatggcggaagcgctgattatcacaccgccggcgttggaaagagggttcaattgggttggtggcgaaacgactgtggatttgactctgtggtgaaactgatgaccacttaggttctctgcaaaccagagaggaacttgcaatttcgatctgttgcaaaatattatatatactaatagtctaaagatgtagttcatcatatatactagtactgatacattcaaaagttatatagcgtttgctgtatggttgagattttcgtcaaaaacaagctgtatcataaatcttttctgtt

SEQ ID NO: 1886 - protein, 185 aa, Glycine max
  G3469,AP2 domain coordinates 16-79
MQKRRAGRKKFHETRHPVYKGVRQRNGKWVSELRQPNNKNARVWLGTFAHPDMAAIAYDVAALAFKGDSASLNFPNAATSFPRLNSRTCSVRAIQFAATQAAEKHFSCVESQQLQREGSGSGSFSLDDDSSEFSSQGRFFWDEEEVFNMPELLNCMAEALIITPPALERGFNWVGGETTVDLTLW

SEQ ID NO: 1887 - DNA, 555 bp, Glycine max
  G3470,family:CAAT
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 1888 - protein, 174 aa, Glycine max
  G3470,CAAT domain coordinates 27-116
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 1889 - DNA, 556 bp, Glycine max
  G3471,family:CAAT
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 1890 - protein, 173 aa, Glycine max
  G3471,CAAT domain coordinates 26-115
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 1891 - DNA, 547 bp, Glycine max
  G3472,family:CAAT
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 1892 - protein, 171 aa, Glycine max
  G3472,CAAT domain coordinates 25-114
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 1893 - DNA, 1818 bp, Glycine max
  G3473,family:CAAT
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 1894 - protein, 170 aa, Glycine max
  G3473,CAAT domain coordinates 23-113
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 1895 - DNA, 553 bp, Glycine max
  G3474,family:CAAT
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 1896 - protein, 177 aa, Glycine max
  G3474,CAAT domain coordinates 25-114
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 1897 - DNA, 600 bp, Glycine max
  G3475,family:CAAT
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 1898 - protein, 188 aa, Glycine max
  G3475,CAAT domain coordinates 23-112
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 1899 - DNA, 528 bp, Glycine max
  G3476,family:CAAT
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 1900 - protein, 165 aa, Glycine max
  G3476,CAAT domain coordinates 26-115
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 1901 - DNA, 602 bp, Glycine max
  G3478,family:CAAT
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 1902 - protein, 191 aa, Glycine max
  G3478,CAAT domain coordinates 23-112
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 1903 - DNA, 736 bp, Oryza sativa (japonica cultivar-group)
  G3479,family:MADS
aatccagctgagatcgatcgatcgatcgatggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 1904 - protein, 235 aa, Oryza sativa (japonica cultivar-group)
  G3479,MADS domain coordinates 2-57
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 1905 - DNA, 723 bp, Oryza sativa (japonica cultivar-group)
  G3480,family:MADS
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatga

SEQ ID NO: 1906 - protein, 240 aa, Oryza sativa (japonica cultivar-group)
  G3480,MADS domain coordinates 2-57
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 1907 - DNA, 782 bp, Oryza sativa (japonica cultivar-group)
  G3481,family:MADS
gtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcaacttcagaaattaagatttggcagagggaggcagcaagcttgaggcagcaactgcacaacttgcaagaaagccacaagcaactgatgggtgaggagctttctggcctaggtgttagagacctacaaggtttagagaataggcttgaaataagtctacgtaatatcagaatgagaaaggacaatcttttgaaaagtgaaatcgaggagttacatgtgaagggaagcctaattcaccaggaaaacatcgaactttctagaagcctaaatgtcatgtcgcaacaaaaattggaactgtataacaagcttcaggcctgtgaacagagaggtgccacagatgcaaatgaaagttccagcactccatacagctttcgtatcatacaaaatgctaatatgcctcctagtcttgaattgagccaatcacagcaaagagaaggggagtgcagcaaaacagctgctccagaactgggacttcatctgccttaagactatgccgtacaagctggacgataagt

SEQ ID NO: 1908 - protein, 241 aa, Oryza sativa (japonica cultivar-group)
  G3481,MADS domain coordinates 2-57
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 1909 - DNA, 636 bp, Oryza sativa (japonica cultivar-group)
  G3482,family:MADS
atgagggggaagggatgctggagcaaaggagaggagggtcaagaggagaagataaaaattaaggagaggatggaggagagaaaaaggtgcagcgtatctagagaaagtagtttctgcacatctgatacccacgccataggtatatttctagctcatttcaggactacccaattttatgaggtggatggtttcaatctttgtttggagttctggcaagcagaggcggaacgtttaaaacagcaactgcataacttagaaggaagtcaaaggcagttgttggcacatgatctctctggccttgaatggaatgacctgaagagtctagaaaatcaactggagacgagcttgcataacgttcgtctaaagaaggacaaaatcatggtcgaacaaattcaagaattgagaaagaaggagaacatcatgcaccgagaaaacatggaactccaccgtgagttcaacatgatccgtcaagatagtgtgaatttccagcgaaaggtttatggaaaacaagatgtaaatggaggacagggaagttctgttactcagaacaccaatactcaggatgatgcagacgaaattcgtcttgagctaagccaaccacaggttccggatgagaaaccagaagcagcagcataa

SEQ ID NO: 1910 - protein, 211 aa, Oryza sativa (japonica cultivar-group)
  G3482,MADS domain coordinates 2-57
MRGKGCWSKGEEGQEEKIKIKERMEERKRCSVSRESSFCTSDTHAIGIFLAHFRTTQFYEVDGFNLCLEFWQAEAERLKQQLHNLEGSQRQLLAHDLSGLEWNDLKSLENQLETSLHNVRLKKDKIMVEQIQELRKKENIMHRENMELHREFNMIRQDSVNFQRKVYGKQDVNGGQGSSVTQNTNTQDDADEIRLELSQPQVPDEKPEAAA

SEQ ID NO: 1911 - DNA, 354 bp, Oryza sativa (japonica cultivar-group)
  G3483,family:MADS
atggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaaggaatatatgtcctcagacttgtttaaagtggttaaagtagggatatctgttgattctaggtatctgtactgtataatattccaccaggcatag

SEQ ID NO: 1912 - protein, 117 aa, Oryza sativa (japonica cultivar-group)
  G3483,MADS domain coordinates 2-57
MGRGKIEIKRIDNATSRQVTFSKRRSGLFKKARELSILCDAEVGLLVFSSTSRLYDFASSSMKSIIERYNETKEDPHQTMNASSEAKEYMSSDLFKVVKVGISVDSRYLYCIIFHQA

SEQ ID NO: 1913 - DNA, 745 bp, Glycine max
  G3484,family:MADS
tttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaacccatcacctcatgaatccggcttcagaagagaagttttggcagacagaagcagcaagcttgaggcagcagcttcagtacttgcaagaatgccacaggcaattaatgggggaagaacttacgggtttgggtattaaagaactacaaaatctggaaaaccaactggagatgagtttaaagggtgtccgcatgaaaaaggatcaaattttaactaatgagattaaagaactacgccaaaagggaaatatcattcatcaagaaaatgttgaactctatcaaaagatggagcagatccaaaaagaaaatgcagagctacaaaagaaggtttatgaagcaaggagtacaaatgaagaaaatgtggcatccaatccttcttacaacgtcagaaatggatatgattcacttgcatctatcagtctccagctaagtcagccacagtctcaatacaaatacagtgaaccatcaaccaaagcaatgaaactcggattgcagctgcattagcaaaaact

SEQ ID NO: 1914 - protein, 241 aa, Glycine max
  G3484,MADS domain coordinates 2-57
MGRGKIAIRRIDNSTSRQVTFSKRRNGLLKKARELSILCDAEVGLMVFSSTGKLYDYASTSMKAVIERYNKLKEETHHLMNPASEEKFWQTEAASLRQQLQYLQECHRQLMGEELTGLGIKELQNLENQLEMSLKGVRMKKDQILTNEIKELRQKGNIIHQENVELYQKMEQIQKENAELQKKVYEARSTNEENVASNPSYNVRNGYDSLASISLQLSQPQSQYKYSEPSTKAMKLGLQLH

SEQ ID NO: 1915 - DNA, 1019 bp, Glycine max
  G3485,family:MADS
attcggctcgaagggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaaattttggcaaagggaggcagcaatgttaaggcaacaattacacaatttgcaagaaagtcaccgcaggaaaatgatgggggaagaactgtcaggcttgacagtcaaagaattaccaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctcacaaatggtctaggcataggagaggatttgcaagtgcctgtgaatctccagctaagccagccaagcaccagcaacaacactacaaggcaccttcaggaactacaaaaatgggcagattgcaattgcattgatccatatacaggatgcgtgtgtttcacaattgctatcaagaaaaatggactcagatttaaacctcgatgtcttcgtataaatgttgtggcatatagaccacagacaaattggcttaaagattttaatttgaaattatcagaaaaagaaaaggcaaccctagcatgtatgtaagaaacaatgaaagcatcttatgagaaaccaagactcaaatcaaggaagaaattcttccacccgccc

SEQ ID NO: 1916 - protein, 286 aa, Glycine max
  G3485,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELPNLENQLEISLHGVRMKKDQLLMGEIQELNRKGNLIHQENVELYKKVYGTQDDNETNRDSVLTNGLGIGEDLQVPVNLQLSQPSTSNNTTRHLQELQKWADCNCIDPYTGCVCFTIAIKKNGLRFKPRCLRINVVAYRPQTNWLKDFNLKLSEKEKATLACM

SEQ ID NO: 1917 - DNA, 691 bp, Zea mays
  G3487,family:MADS
ggagatggggagagggaagatagagatcaagaggatcgacaacgcgacgagccggcaggtaacgttctccaagcgccggggcgggctgttcaagaaggccaaggagctcgccatcctttgcgatgccgaggtcggcctcgtcgtcttctccagcaccggccgcctgtatcacttcgctagcaccagcatggaatctgtgattgaaagatacgaggaaagagaggggcaccatcagactatgagcgcaagtgctgaggccaagctttggcaaagggaggcaggaagcttgaggcagcaactgcataacttgcaagagcaccatcggaagttgttgggtcagcagctctctggcctggacgtgagagatttgcagaatttagagaatcagctggagacaagcctaagaaatattcgtctaaagatggaccaacttattttttatcagattcaagaattaaacaggaagggatacctcatgcaccaggaaaacatagaactacacaacaaagtcaaccttcttcatcaagagaacattaaattacgtagaaaggcgtatggacaaggagtaaatgagcatccaacaagtactacagttagacacagtattctgaatacagagaatgaagatgttcggatcaatcttgagctgagtgtgcaaagggacaaatcagaaacaccaagtgtagggtga

SEQ ID NO: 1918 - protein, 228 aa, Zea mays
  G3487,MADS domain coordinates 2-57
MGRGKIEIKRIDNATSRQVTFSKRRGGLFKKAKELAILCDAEVGLVVFSSTGRLYHFASTSMESVIERYEEREGHHQTMSASAEAKLWQREAGSLRQQLHNLQEHHRKLLGQQLSGLDVRDLQNLENQLETSLRNIRLKMDQLIFYQIQELNRKGYLMHQENIELHNKVNLLHQENIKLRRKAYGQGVNEHPTSTTVRHSILNTENEDVRINLELSVQRDKSETPSVG

SEQ ID NO: 1919 - DNA, 1209 bp, Zea mays
  G3488,family:MADS
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaa

SEQ ID NO: 1920 - protein, 240 aa, Zea mays
  G3488,MADS domain coordinates 2-57
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 1921 - DNA, 784 bp, Zea mays
  G3489,family:MADS
aagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatatatgagactgaaggaccaagtggagttaatcgggagtcaccgactccattcaactttgcagtagtagaaaccagagatgttcctgtgcaacttgaactcagcacactgccacagcaaaataacattgagccatctactgctcctaagctaggattgcaattaattccatgaagaagagtaaaactgccgtcttatgatgct

SEQ ID NO: 1922 - protein, 240 aa, Zea mays
  G3489,MADS domain coordinates 2-57
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 1923 - DNA, 1105 bp, Zea mays
  G3490,family:HB
gccatctgttcaaaataaatatatatataatcgtcgtcatgcatatttcgatttttcgaatcgtgcgaaactagcttgtctgttgtgtttacttatatatattctgaaagtactccgtattttctggagtcaagaacagcatactgtattttctgtgatttttaaaggagctaacttggctatatatgaacaaccgatggttgttgcttggcggccgcagaggggtttggatgcaacaacaacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcgccatgtgcccgcgctgcgagcgcatctccgccgcaacggccggcgcgcaccccacgcccggcgcccgccgcgagccccttccacccgcgccgcccgtccgcggcgttttagcctagtctcccgctgcatgcgactccggccggtaggggaaggagcggaaagtttggttgttgttagggggggcaaagtgtttgtgctgtgtaaatttgatgatggatggagaaaaccagcgcgggcccgtgtagctttttaggtgtaggtggtagggtttcgaccttggagtcccttcgcgtcaacgtccccgtccccgtgttccgttccatgccgtgcatgctgatggatcaaaagtttgtactagcttcctatcgtcgtcactccattcagaatga

SEQ ID NO: 1924 - protein, 211 aa, Zea mays
  G3490,HB domain coordinates 60-120
MVVAWRPQRGLDATTTTGAGTGNNMRDLDMNQPASGGEEEEFPMGSVEEEEDERGGAGGPHRAKKLRLSKEQSRLLEESFRLNHTLTPKQKEALAVKLKLRPRQVEVWFQNRRARTKLKQTELECEYLKRCFGSLTEENRRLQREVEELRAMRVAPPTVLSPHTRQPLPASALAMCPRCERISAATAGAHPTPGARREPLPPAPPVRGVLA

SEQ ID NO: 1925 - DNA, 1635 bp, Oryza sativa (japonica cultivar-group)
  G3491,family:HS
gaccctcaccacgcctccccatacggatcgcctcatggaggccgccgttgctgctgcggctgcggccgccggggcggtgacgacggcggtcgcgcctccgcccggcgcggcggtcagcaacggggtggcgaccgcgccgccgccgttcctgatgaagacgtacgagatggtggacgacccggccaccgatgccgtcgtctcatggggccccgggaacaacagcttcgttgtgtggaacacccccgagttcgcgcgcgacctcctccccaagtacttcaagcacagcaacttctcctccttcgtcaggcagctcaacacctacggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacct

SEQ ID NO: 1926 - protein, 506 aa, Oryza sativa (japonica cultivar-group)
  G3491,HS domain coordinates 38-130
MEAAVAAAAAAAGAVTTAVAPPPGAAVSNGVATAPPPFLMKTYEMVDDPATDAVVSWGPGNNSFVVWNTPEFARDLLPKYFKHSNFSSFVRQLNTYGFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 1927 - DNA, 1799 bp, Glycine max
  G3494,family:HS
attcggctcgaggtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcgcctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgcttttaaggccaagcccacttacagaaggcacagaggaaactaaatgtagctctctaggatgtggtttgactgatgatcagggtttgccttcagaaatgggaaataagcaggaaaattttgatacgatactacatgttgaccgtcttactcaacagatgggacttcatgcattggagtactgattgtgtgtatatatgttactcgcaactgaaggtaaactttttagcttgcagcctctcacttatgcataactttataagcatactggctctcttagttccctgaactgaaaccagtgtaaaatctcctgtcattgtcatcatacccaattgctgccattaaagagtgagaacagtgaggcagtaaatcaggagtgtttaaaacaattacagtgaatgtctacgaaaatgtctgatgtattatgatcttacatacacattattaggatagaaatttactacgtaacaaaaaa

SEQ ID NO: 1928 - protein, 464 aa, Glycine max
  G3494,HS domain coordinates 14-105
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELLLRPSPLTEGTEETKCSSLGCGLTDDQGLPSEMGNKQENFDTILHVDRLTQQMGLHALEY

SEQ ID NO: 1929 - DNA, 1819 bp, Glycine max
  G3495,family:HS
ggagggaagtggaagctagtagtccgtttcagcgtgtgtgatactttcctttcatcttcttcttctctctgcgataaaagcaaaacctaaaatttggtttaggcataggaatctgttgtagagttgatctacctggaatggagggagcatcgtggaatagtagtgtttgtgtggcaccgtttctgagcaagacctacgacatggttgatgatccttccaccgacttagtggtgtcgtggggcgaaaacaacaactcctttgttgtttggaacgttccccaattcgccacagacatcttgcccaatcattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagagcccatgcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggatggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtatacaaaaaaaaaa

SEQ ID NO: 1930 - protein, 464 aa, Glycine max
  G3495,HS domain coordinates 14-105
MEGASWNSSVCVAPFLSKTYDMVDDPSTDLVVSWGENNNSFVVWNVPQFATDILPNHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPCFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 1931 - DNA, 859 bp, Medicago sativa
  G3497,family:AP2
tctttccttcaaaaccaagtatgcttccctatatatataacgcaccttactcttcattctcttaaatcaaactctctctccaattcccactttccctcccaaaacaattttccactctctccaacacatacatatgttgactactaacaactcttccaattcacaatccatttcctcaacagcatcttcttcgtacgacatgtcaactccgaatttggaggtacgattagccgctagtaatccaaagaagcgagcagggaggaagatattcaaggaaactcgccacccggtgtatagaggtgtgaggaagagaaacttagataaatgggtgtgtgaaatgagggagcccaacacgaagactaggatttggctagggacttttccaaccgccgagatggcagcccaagctcacgatgttgcagccatggcattgaggggccgctacgcctgtgtcaattttgcagactcggtgtggcgccttcctattccagcaacctccaagataaaagatattcaaaaggctgctgctgaagctgcagaagcttttagaccagacaagactttaatgactaacgatattgacacggttgtagctgttgtcgccacaaaggagttgaatatgttttgtgtggaagtcgaagatgacgtgttgaatatgccagagttgtggaggaatatggcactaatgtctcgtacacatagctttgggtatgatgatcagtatgaagatattcatgtacaagactttcaagatgatgaggtatcactatggaacttctaaattttgtgtttggtttaattttatttttggattgtagaataggaaatgtctatactacaacctttttaattggtagca

SEQ ID NO: 1932 - protein, 215 aa, Medicago sativa
  G3497,AP2 domain coordinates 51-114
MLTTNNSSNSQSISSTASSSYDMSTPNLEVRLAASNPKKRAGRKIFKETRHPVYRGVRKRNLDKWVCEMREPNTKTRIWLGTFPTAEMAAQAHDVAAMALRGRYACVNFADSVWRLPIPATSKIKDIQKAAAEAAEAFRPDKTLMTNDIDTVVAVVATKELNMFCVEVEDDVLNMPELWRNMALMSRTHSFGYDDQYEDIHVQDFQDDEVSLWNF

SEQ ID NO: 1933 - DNA, 851 bp, Medicago sativa
  G3498,family:AP2
tctttccttcaaaaccaagtatgcttccctatatatgtatataatccaacttactcttcattctcctaactctctccaattcccacttttcctcttaaaacaattttccactctctacacatacatatgtttactactaacaactcttcctattcacactccatttcctcaaaagcatcttcttcctactataactcattaccggattcggagatacgattagcggctagtaacccgaagaagagagcagggaggaagatattcaaggaaactcgccacccggtgtatagaggtgttaggaagaggaacttagacaaatgggtgtgtgaaatgagggagcccaacatgaagactaggatatggctaggaacttttccaacagccgatatggcagcccgagcccatgatgttgctgcaaaggcattgaggggacgctacgcctgtctcaatttcgcatactcggtgtggcggcttcctattccagcaacttcctcgataaaagatattcaaaaggcagcaacaaaagccgccgaagcttttagaccagaccatactataatgattaccgatattgagactgttgtagctgtcgtcgccacaaaggatctgaatatcttttgtggggaagaagagcatgaaatgttagatatgtctgagttgtggaggaatatggccctcatgtcccctacgcatagcttttcaaatgatcattatgaagatattcaagcacaagattttcaagatgatgaggtatcactatggaactattaaaaaaaaattgtttggtttaattttatttttggattgtagaataggaaatgtctatactacaacctttttaattggtagca

SEQ ID NO: 1934 - protein, 214 aa, Medicago sativa
  G3498,AP2 domain coordinates 50-114
MFTTNNSSYSHSISSKASSSYYNSLPDSEIRLAASNPKKRAGRKIFKETRHPVYRGVRKRNLDKWVCEMREPNMKTRIWLGTFPTADMAARAHDVAAKALRGRYACLNFAYSVWRLPIPATSSIKDIQKAATKAAEAFRPDHTIMITDIETVVAVVATKDLNIFCGEEEHEMLDMSELWRNMALMSPTHSFSNDHYEDIQAQDFQDDEVSLWNY

SEQ ID NO: 1935 - DNA, 715 bp, Medicago sativa
  G3499,family:AP2
cttactactagtactactacatacaccccacaaatgaaatcatcacttgatgagtctagttacgtagagaacaactcttcttcatctgaaacaagttgctacgaagaaatcttgttagcatcagaacgaccaaagaaacctgcgggtagacgaaaattcaaagagacaagacatccagtttacagaggagtacgaaggaggaacaacaacaagtgggtttgtgaagtgcgtgttcctaacgacaagtccacgaggatttggctaggaacatatccaacacctgagatggcagcacgtgcacacgacgttgccgcactggcacttcgtggtaaatcagcttgtcttaattttgctaactccgcgtggcggttggcgttgccggagacgaacaatgcgaaggagattaggaaaatggcggcggaggctgctttggcatttgccgttgaggacagtaaggaacaaattatgattagtaattgtgatgtttgtagcagcgataatgttatggaagttgataataaacctttgcagggactgtgtgtggaagttccagagcaggaaatgttgcatgattggtttaggagtatggctgatgagcctttacgatctcctatgactccatttataagatatggtattggtagggatcactcaaataatgttgatgttgatccatgttgatcctgaggtgtgcttgtggaactttaccatctaa

SEQ ID NO: 1936 - protein, 215 aa, Medicago sativa
  G3499,AP2 domain coordinates 46-111
MKSSLDESSYVENNSSSSETSCYEEILLASERPKKPAGRRKFKETRHPVYRGVRRRNNNKWVCEVRVPNDKSTRIWLGTYPTPEMAARAHDVAALALRGKSACLNFANSAWRLALPETNNAKEIRKMAAEAALAFAVEDSKEQIMISNCDVCSSDNVMEVDNKPLQGLCVEVPEQEMLHDWFRSMADEPLRSPMTPFIRYGIGRDHSNNVDVDPC

SEQ ID NO: 1937 - DNA, 1354 bp, Solanum lycopersicum
  G3500,family:MYB-(R1)R2R3
aaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 1938 - protein, 347 aa, Solanum lycopersicum
  G3500,MYB-(R1)R2R3 domain coordinates 14-118
MGRVPCCDKMGVKKGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKRLDQCHGSNDLFSLENGLTHLSSSNSSTSRGQWERTLQADINMAKKALHNALSLENPTSSHNNNIKQENTQVSSTSTIYASSTENIARLLQGWIGSSTSSTNNSESSKTSSNNIATTDSSSCDGTPNAETKGGMGLMEAFESLFGLESFESSSSDELSQTTTPEAIKIEIKKEENEHDVEVPLSIILENWLLDENTLNIQPKNDLTTLISFDETPQLFYKFFFLLILLME

SEQ ID NO: 1939 - DNA, 1426 bp, Solanum lycopersicum
  G3501,family:MYB-(R1)R2R3
tataaacatagctagagaaaaaaaaaaaaaacttcaagaaaatcaaaagtgcttttgttgttgaattaaatcaaagaagatttgtttattttgatttttagaaatgggaaggcctccttgttgtgaaaaaagtggggtgaaaaaagggccatggacaccagaagaagatatcattttggtttcatacattcaagaacatggccctggaaactggagaaatattccaactaatactggtttgctaagatgcagcaaaagttgtagacttcgatggactaattatctccggccagggatcaaacgtggaaacttcactgaacatgaagaaaaaatgatcatccatcttcaagctcttcttggcaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgacctttagctgaaactaatgatttgttttgaagaaaaaaaaaattgtttactagtactcccttcgtttcaatttatctgccttgatttgaccgaacatgaaagtgaagaaaaaaaataagtaaaacggataaattgaagcgcagggagtagtaaatatttcttcaaacaacataggacagtttggggtaagtgggcttttggggtattttaatagttgg

SEQ ID NO: 1940 - protein, 371 aa, Solanum lycopersicum
  G3501,MYB-(R1)R2R3 domain coordinates 14-118
MGRPPCCEKSGVKKGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNNNKKVEGHDDHQEGTSASSSSSQSKIIKGQWERRLQTDIHTAKQALCDALSLDTTPNNKNNNNNPPPHDQDQQPPSVQTPTTYASSAENIAKLLQNWMKNSPKSTSSSSSKITPMSSLNNNLSIGAVSSSSPSEGTVNVTPGQGLDSIFSFNSSNNSDVSQSVSVDEGGNFSTPENHNNNNNNNAGIYQVESKPNLPDFKPENGNFQEESKQNMETQQVPLTMLEKWLLEDANAQAEQEDQLMGIGMGMGMTFS

SEQ ID NO: 1941 - DNA, 936 bp, Oryza sativa (japonica cultivar-group)
  G3502,family:MYB-(R1)R2R3
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 1942 - protein, 311 aa, Oryza sativa (japonica cultivar-group)
  G3502,MYB-(R1)R2R3 domain coordinates 14-119
MGRPPCCVKAEVKKGPWTPEEDLMLVAYVQEHGPGNWRAVPTNTGLMRCSKSCRLRWTNYLRPGIKRGNFTDQEEKLIVHLQALLGNRRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 1943 - DNA, 823 bp, Oryza sativa (japonica cultivar-group)
  G3503,family:MYB-(R1)R2R3
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatga

SEQ ID NO: 1944 - protein, 251 aa, Oryza sativa (japonica cultivar-group)
  G3503,MYB-(R1)R2R3 domain coordinates 14-116
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 1945 - DNA, 763 bp, Oryza sativa (japonica cultivar-group)
  G3504,family:MYB-(R1)R2R3
gacgactcgccgccggcctagaccaacagcgatggggaggtcgccgtgctgcgagaaggagcacactaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactacctccgccccgacctcaagcgcggcaacttcaccgccgacgaggacgacctcatcatcaagctccacagcctcctcggcaacaagtggtctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatga

SEQ ID NO: 1946 - protein, 243 aa, Oryza sativa (japonica cultivar-group)
  G3504,MYB-(R1)R2R3 domain coordinates 14-116
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 1947 - DNA, 1042 bp, Oryza sativa (japonica cultivar-group)
  G3505,family:MYB-(R1)R2R3
ctgtacccccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaaggcggcaccaccgccgccgcatcccatatccgtcccggcgaaggcggcggccgcggcgatcttcgccgtggcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttct

SEQ ID NO: 1948 - protein, 260 aa, Oryza sativa (japonica cultivar-group)
  G3505,MYB-(R1)R2R3 domain coordinates 14-116
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 1949 - DNA, 1037 bp, Oryza sativa (japonica cultivar-group)
  G3506,family:MYB-(R1)R2R3
aaaagctattactactagtacaaaaccaacgcgaagctctcgtcgcgcacaaccaactcgacaccgcggcgaggcgaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccggggaggacggacaacgagatcaagaactactggaacacgcacatcaagcgcaagctcctgagccggggcatcgacccgcagacgcaccggccggtcagcgccgggagcagcgccgccgcggcgagcgggctgaccacgacggccagcaccgccgcctttccgtcccttgcgccggcgccgccgccgcagcagcacaggctacacaacccggtgcacgccgcggcgccgagcaatgcgagcttcgccaggtccgcggcgtccccgccgtcggaggacggccacagcagcagcggcggcagctcggacgcgccgcggtgccccgacctcaacctcgacctcgacctcgacctgtccatgagcctgccgagctcgccgcccaagacgccggccgccgcgtcgtccacgaccgcgtcgcgccaccatcaccaccagcagcagaagaccatctgcctctgctaccacctcggcgtccgcaacggcgacgtctgcagctgcaaggcggccgcgccatcgccggccggcccacgcgcgttccggtttctcaggccactggaggagggccagtacatatagcacagcaggctttagggaaaaaaaacctgtaaaaaacacaaaaaaaaacggtgggcaatagagttttttctaagttc

SEQ ID NO: 1950 - protein, 287 aa, Oryza sativa (japonica cultivar-group)
  G3506,MYB-(R1)R2R3 domain coordinates 14-116
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 1951 - DNA, 1027 bp, Oryza sativa (japonica cultivar-group)
  G3507,family:MYB-(R1)R2R3
ttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgctcacgcaccgcccgctcaatgccgccgccgccgtcgccggccaccaccacctcgccgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatcatcatc

SEQ ID NO: 1952 - protein, 266 aa, Oryza sativa (japonica cultivar-group)
  G3507,MYB-(R1)R2R3 domain coordinates 14-116
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 1953 - DNA, 888 bp, Oryza sativa (japonica cultivar-group)
  G3508,family:MYB-(R1)R2R3
atggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataa

SEQ ID NO: 1954 - protein, 295 aa, Oryza sativa (japonica cultivar-group)
  G3508,MYB-(R1)R2R3 domain coordinates 14-116
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 1955 - DNA, 1152 bp, Solanum lycopersicum
  G3509,family:MYB-(R1)R2R3
cacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaatatagcactaatgattctatgaagataatttttctttttcctctaaaaaaaaaaaaaaaaaaaa

SEQ ID NO: 1956 - protein, 273 aa, Solanum lycopersicum
  G3509,MYB-(R1)R2R3 domain coordinates 14-116
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 1957 - DNA, 1174 bp, Oryza sativa (japonica cultivar-group)
  G3510,family:HB
tctccctccgcctttgccccgccttccctgcccttttctcttgctgagccgcttctgcattggcttgtgatgatgggggccacttctccgtcaggcctggagctcaccatggctgtccccggcctcagctcctctggttcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccgaagcaaaaggaggccttggcgatcaaactgaagctgcggccgaggcaggtggaggtctggtttcagaaccgtagggcaaggacgaagctgaagcagacggagatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattgaaggagacgacgcagcggtagagggccccgtgtcggcgttgttgcgtcgggtccagtcgtctcagaggagtcagaggcgtggacaaaatgtttgttgcggtgtttgtgttccattggtcgttgatcttagcttgatgatctgtgattcgcgccttgctcgtctaggtttctcttgggccgacgcatgatcttttttcccccgtgtcggaccttattgggccttttgagatcgacgggccccctccttgtttcgcatgtggacatgttatttcgtccttttgggccaacaattcagcacggtggccaacggtgcgtagttcgtcgccgttttctttcaaaaaaaaaaaaaaaaaa

SEQ ID NO: 1958 - protein, 229 aa, Oryza sativa (japonica cultivar-group)
  G3510,HB domain coordinates 74-134
MMGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 1959 - DNA, 1803 bp, Glycine max
  G3512,family:HS
gatactctcctcttatcttctgcttcttcttccttcttctctgagcgataaagcagcaaaaacctaaaattaggggtttatggagggagcatcgaggaatggtagtgtttgtgtggcaccgtttctgagcaagacatacgacatggtcgatgatccttccaccgactcggtggtgtcgtggggcaaaaacaacaacaccttcgttgtttggaacgttccccaattcaccacagacatcttgcccaaacattttaagcacaacaacttctccagcttcgtcagacagttgaatacttatggttttagaaaggttgacccagatcgatgggaatttgcaaatgaaggatttttaagaggtgaaaaacaacttttaaaaagtatcagtaggcggaaatctgctcatgtaaatggtagtcaacaagcatctcaagtgcataaatcagctgctggagcatgtgttgaagtggggaaatttgggcttgaggaagaggtggaaagactgaaaagggataagaatgttcttatgcaggaacttgttaggttgagacagaaacagcaagggactgataaccaattgcaaaatgttgggcaacgtgtgcagtcaatggagcagcgtcagcagcaaatgatgtcattcctggctaaggccatgcagaagccaggcttcttagctcaatttgttcagcagcagaatgaaagtagtaaacatatccctgggagcaataaaaagaggaggctccagcgacaagaagaagatagtttagccaccaaggatctccatagttctcttgatggacacattgtcaagtaccagagttccataaatgaggctgcaaaagcattatttcgccagatattgcaaataaacaattctacaacacaatcatcaattaagaaccctgatgttttccttattgatgatattccttctgccattgcatcagatagcagtagttcatccactcaggtttctaatgtgatggttccacctatatctgagctgacgtctatggaagtaggatcacagtttcctctcagttgtatgcccagtaacatatctgaggtgcagtcttcacctgctgttttgggtttctgtagaagtcaggggttggagacagaaagcagtttattgaatcatgagctgaatgttatgggggctgatactaggaacatgggggagatagatatgatgtcaactgttttagatgaggcagacgaagctgatcatttttcacctgacacagatggaatttctaaactcccagaaatcagtgatgaattctgggaactgtttttaaggccaagcccacttacagaagacacagaggaaactaaatgtagctctctaggatgtggtttgactgaagatcagggtttgccttcagaaatgggaaataagcaggaaaattttgatacaatacaacatgttgactgtcttactcaacagatgggacttcatgcattggagtactgattgtgtgtatatatgttactcacaactgaaggttgaggtcccctttgctactgagcagacaaagccatcttacttatacaacaaagaaacctgacagatccaacaacttgatcggtgcttttatccgcttgtaatgtcgtcgtgtgttctgtttgtcattgggggcttaaaaacatacaagttcacgaaacttcatatatctccatgtattttgaattttaataactatgcccccgtttccaatgcgatgatatttttgtggggatgttccgtataattggatcataactcttgaattgctgttgaataactactgtttactgaagcta

SEQ ID NO: 1960 - protein, 464 aa, Glycine max
  G3512,HS domain coordinates 14-105
MEGASRNGSVCVAPFLSKTYDMVDDPSTDSVVSWGKNNNTFVVWNVPQFTTDILPKHFKHNNFSSFVRQLNTYGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQKPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGLETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 1961 - DNA, 466 bp, Oryza sativa (japonica cultivar-group)
  G3515,family:AP2
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 1962 - protein, 141 aa, Oryza sativa (japonica cultivar-group)
  G3515,AP2 domain coordinates 11-75
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 1963 - DNA, 393 bp, Zea mays
  G3516,family:AP2
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 1964 - protein, 130 aa, Zea mays
  G3516,AP2 domain coordinates 6-70
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 1965 - DNA, 477 bp, Zea mays
  G3517,family:AP2
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 1966 - protein, 132 aa, Zea mays
  G3517,AP2 domain coordinates 13-77
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 1967 - DNA, 717 bp, Glycine max
  G3518,family:AP2
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 1968 - protein, 158 aa, Glycine max
  G3518,AP2 domain coordinates 13-77
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 1969 - DNA, 609 bp, Glycine max
  G3519,family:AP2
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 1970 - protein, 151 aa, Glycine max
  G3519,AP2 domain coordinates 13-77
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 1971 - DNA, 440 bp, Glycine max
  G3520,family:AP2
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 1972 - protein, 138 aa, Glycine max
  G3520,AP2 domain coordinates 14-78
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 1973 - DNA, 1096 bp, Glycine max
  G3524,family:HB
tgcttcttctgtcttccttttcatgtgtgtctccttctgtttctccactttaccttttttctctcctttttgttgatccccctcttcctcttcttcatctcacatcatttttttcttcatccctttcattgttttctgtgtgttttctatggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcgtctccttgaagaaagctttagacaaaaccacacgttgaacccaaagcagaaagagtctttggcaatgcaactgaagctgcgaccaaggcaagtggaggtgtggtttcagaaccgtagggccaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttgaccctataactatagtccatcgcctactctgcacgccacctctactacctcatcatctaattaatcagaaacagggcacaaacttaactaaactttacaaaactaaaaagttagtgtgaatgaagatataatatgtgttagaaaaaataatgtttttttttttttttttactaaaagggcgttttcggatagggaaacttttgtagttagtagtagtactttcaatggtcaatgcgtatctgattattgggctttcatattgactttctcctttttcaaatatggatagaacttttatttaaaaaaa

SEQ ID NO: 1974 - protein, 213 aa, Glycine max
  G3524,HB domain coordinates 60-120
MAVLPSSSSSLELTISVPGFASSPTLLPSSSVKELDINQVPLEEDWMASNMEDEEESSNGEPPRKKLRLTKEQSRLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 1975 - DNA, 1096 bp, Glycine max
  G3527,family:MYB-(R1)R2R3
ggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttggaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaat

SEQ ID NO: 1976 - protein, 253 aa, Glycine max
  G3527,MYB-(R1)R2R3 domain coordinates 13-117
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 1977 - DNA, 1172 bp, Glycine max
  G3528,family:MYB-(R1)R2R3
ctttaacctgtctcaccaactcgcatctagaagcaattagggtctcccttttctctctatgtctcctttggagtcaaaagcctataaaaccacacccaaactccctcttgagccggcttcttaaatatttgttgctgcaagctagccaatcctaattcctattcctatccttattactacataactctaaagtaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaacggtacagttgaaca

SEQ ID NO: 1978 - protein, 246 aa, Glycine max
  G3528,MYB-(R1)R2R3 domain coordinates 13-117
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAYDFLGMKTSGVWDCTRLEMK

SEQ ID NO: 1979 - DNA, 866 bp, Glycine max
  G3529,family:MYB-(R1)R2R3
gtggagagcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaa

SEQ ID NO: 1980 - protein, 235 aa, Glycine max
  G3529,MYB-(R1)R2R3 domain coordinates 14-116
MGRSPCCEKAHTNKGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKLLSRGIDPATHRPLNDSSHQEPAAVSAPPKHQESFHHERCPDLNLELTISPPHHPQPDHPHLKTLVTNSNLCFPCSLGLHNSKDCSCALHTSTANATATGYDFLALKTTVVLDYRTLHMK

SEQ ID NO: 1981 - DNA, 727 bp, Arabidopsis thaliana
  G353,family:Z-C2H2
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 1982 - protein, 162 aa, Arabidopsis thaliana
  G353,Z-C2H2 domain coordinates 41-61,84-104
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 1983 - DNA, 920 bp, Zea mays
  G3531,family:MYB-(R1)R2R3
ccacgcgtccggtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaa

SEQ ID NO: 1984 - protein, 218 aa, Zea mays
  G3531,MYB-(R1)R2R3 domain coordinates 14-116
MGRSPCCEKAHTNKGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKLLSRGIDPVTHRPINEHTSNITISFEDWGQGKALKCPDLNLDLCISPPCQEEEEAMLLRPVKREEAGLCFSCSLGLPKSADCKCSNFLGLRTAMLDFRRLEMK

SEQ ID NO: 1985 - DNA, 1372 bp, Zea mays
  G3532,family:MYB-(R1)R2R3
gcacgagctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctcccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctgtatctctgtaattaccatcgccaaatgatcatgggggcaaaatctttttgggtctctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1986 - protein, 273 aa, Zea mays
  G3532,MYB-(R1)R2R3 domain coordinates 14-116
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEERNKATMVVGRDRQSQSQSHSHPAGEWGQGKRPLKCPDLNLDLCISPPCQEEEEMEEAAMRVRPAVKREAGLCFGCSLGLPRTADCKCSSSSFLGLRTAMLDFRSLEMK

SEQ ID NO: 1987 - DNA, 1420 bp, Zea mays
  G3533,family:MYB-(R1)R2R3
ctaccacccaccaactttagctctgtagaagacctaccctcccgggattcctcagtaaagtgcgtatgcctatctataaaatccagccccgcttcacccacacacctttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaa

SEQ ID NO: 1988 - protein, 275 aa, Zea mays
  G3533,MYB-(R1)R2R3 domain coordinates 14-116
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEEERNKATMVVGRDRQSQSQSHSHPAGEWGQGKRPLKCPDLNLDLCISPPCQEEEEEMEEAAMRVRPAVKREAGLCFGCSLGLPRTADCKCSSSSFLGLRTAMLDFRSLEMK

SEQ ID NO: 1989 - DNA, 963 bp, Zea mays
  G3534,family:MYB-(R1)R2R3
gtagcaacaagcaaaagcccagatcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaggcgacggccgccaaggcgcccagatgccccgacctcaacctcgacctctgcatcagcccgccgtgccagcagcaggaggaggaggaggaggtggacctcaagccctccgccgccgtcgtcaagcgggaggttctgctgggcggccgcggccacggccacggcggggcgctctgcttcggctgcagcctgggcgtccagaagggcgcgcccgggtgcagctgcagcagcagcaacggccaccgctgcttggggctcaggggcggcatgctggactttagaggcctcaagatgaagtgaacgaagcccagcgagatgggcggattcttctggttcgtcggtttggttggttctcgccttgatggatctggatagctagttcctggtaggaggatagtggaagatgagaaggagagccaagatggcgagaggattcgtggctcgtggatagcttagttcctccg

SEQ ID NO: 1990 - protein, 254 aa, Zea mays
  G3534,MYB-(R1)R2R3 domain coordinates 14-116
MGRSPCCEKAHTNRGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKLLGRGIDPVTHRPIAADAVTVTTVSFQPSPSAAAAAAAEAEATAAKAPRCPDLNLDLCISPPCQQQEEEEEVDLKPSAAVVKREVLLGGRGHGHGGALCFGCSLGVQKGAPGCSCSSSNGHRCLGLRGGMLDFRGLKMK

SEQ ID NO: 1991 - DNA, 1672 bp, Glycine max
  G3537,family:MYB-(R1)R2R3
gataattgagcttttcccagtgcagctacattgaatgtcacgcggtttcgagagagaggtatctatgaggtgaataattttggtccttactccttcagttaatgctcttgctgtcaacttttgacttggctacctggtttactagtttaagtcagcttctcatcacaccccacaccatacatatccttacccctttcatttttagctataaatgtgcatcaagcaaaggttaggctccgagacgtccgattagaaccctatcaagtaaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggggcaacttcacagaacaagaggagaagatgataatccatcttcaagatcttttaggaaacagatgggctgcaatagcttcataccttccacagagaacagacaatgacataaagaactattggaacacccatttgagaaagaagctgaagaagatgcaagtaggttgtgaaggtggtagctttggagaagggttttcagcctcaaggcaaatccctagaggccagtgggaaagaaggctccaaactgatatccaaatggcaaagagagccctcagtgaagctctttcaccagagaagccatcttgtaatttatctgcctcaaactcaaacccttcagatagtagcagctccttctcttccacaaaaccaacaacaacacaaactgtgtgctatgcctcaagtgctgacaacatagctagaatgctaaagggttggatgaaaaacccaccaaagtcctcaagaacaaactcatcatctgtgactcagaactccttcaacaactttgctgcagcaggtgctgatactgcttctagtattggagcaaagggaccaccaagcagtgctgaattgtctgaaaacaattttgaatcattgtttgattttgatcagtctttggagtcttcaaactctgatgaattctctcggtcattgtctcctgaggccactgttttgcaagatgaaagcaagcctgatgttattggtgcagaaattatgccattctctttgcttgagaaatggcttcttgatgaggctggttgccaagagaaattagttggttgtggtgatgatgccaagtttttctaagttgggttcattttgtgacatatatgagactgtggaattttttattttatttcataagttataggtagggcctcatcaattaatcttcgctttggccttagagagagaagtttttcaagcctttggtgctagacgtgtatatgttaataactattgaaattatgattattgttatcatactgtgttagatgccacactggaaaacaagcaactaagatgtaaagttgatcctgcgatg

SEQ ID NO: 1992 - protein, 334 aa, Glycine max
  G3537,MYB-(R1)R2R3 domain coordinates 14-118
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQVGCEGGSFGEGFSASRQIPRGQWERRLQTDIQMAKRALSEALSPEKPSCNLSASNSNPSDSSSSFSSTKPTTTQTVCYASSADNIARMLKGWMKNPPKSSRTNSSSVTQNSFNNFAAAGADTASSIGAKGPPSSAELSENNFESLFDFDQSLESSNSDEFSRSLSPEATVLQDESKPDVIGAEIMPFSLLEKWLLDEAGCQEKLVGCGDDAKFF

SEQ ID NO: 1993 - DNA, 1342 bp, Glycine max
  G3538,family:MYB-(R1)R2R3
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgacaacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 1994 - protein, 337 aa, Glycine max
  G3538,MYB-(R1)R2R3 domain coordinates 13-117
MGRPPCCDKGVKKGPWTPEEDIILVSYIQEHGPGNWKAVPANTGLSRCSKSCRLRWTNYLRPGIKRGNFTDQEEKMIIHLQALLGNRWAAIAAYLPQRTDNDIKNYWNTYLKKKLNKKLEAGSDQGSLLGGGHNNIGFSSVSQPMSRGQWERRLQTDIHMAKKALSEALSPNKASSSSSTLLAESNSNLSNENSTFYNSNTNKPTTTQSMCYASSADNIARLLKGWMKNTPKSASCAASAVTQNSCSSSEGITTTKGSTTSTSTVELSETFESLFGYESFDNYSSNSEFSPSLSPEATLFQDEGKPDITTGLIDMPFSLLEKWLLDVDAGSQEKLGF

SEQ ID NO: 1995 - DNA, 1472 bp, Glycine max
  G3539,family:MYB-(R1)R2R3
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggtggtagctttggagaagggttttcagcctcaaggcaaatccctagaggccagtgggaaagaaggctccaaactgatatccaaatggcaaagagagccctcagtgaagctctttcaccagagaaaaagccatcttgtaatttatctggcacaaactcaaacccttcagataggagcagctccatctcttccacaaaaccaacaacaacacaaactgtgtgctatgcatcaagtgctgacaacatagctagaatgctcaagggtgggatgaagaacccaccaaagtcctcaagaaccaactcgtctatgactcagaactcattcaacaacttagcaggtgctgatactgcttgtagtagtggagcaaagggaccactaagcagtgccgaattgtctgagaataattttgaatccttgtttgattttgatcagtctttggagtcttcaaactctgatcaattctctcagtccttgtctcctgaggccactgttttgcaagatgaaagcaagcctgatattaatattgctgcagaaattatgcccttctctttgcttgagaaatggctccttgatgaggcaggttgccaagagaaattagttggttgttgtggtgatgccaagtttttctaagttgggttcattttgtgacatatgagactgtgggatttttttattttattttattttatttcataagttataggtagggcctcatcaattaatctcgcttcggccttattagagagagaagttttccagcctttggtgctagacgtgtatatgttaattattattgacattatgatgattattatcatactgtgttagttgccatacactggcaaacttgcttctcttatgtaaagttgatcttgcgacgagatcttgctttatgaattaattgtttttaaagtaaaaaa

SEQ ID NO: 1996 - protein, 333 aa, Glycine max
  G3539,MYB-(R1)R2R3 domain coordinates 14-118
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQAGGEGGSFGEGFSASRQIPRGQWERRLQTDIQMAKRALSEALSPEKKPSCNLSGTNSNPSDRSSSISSTKPTTTQTVCYASSADNIARMLKGGMKNPPKSSRTNSSMTQNSFNNLAGADTACSSGAKGPLSSAELSENNFESLFDFDQSLESSNSDQFSQSLSPEATVLQDESKPDINIAAEIMPFSLLEKWLLDEAGCQEKLVGCCGDAKFF

SEQ ID NO: 1997 - DNA, 1369 bp, Zea mays
  G3540,family:MYB-(R1)R2R3
gcaccagacggaatcgatcgatcggtgctttgatctctgagcctgagcaagcggtcgagctcaccaaccgccacgctcaagacaggtcgagtagctagctagctgccggagcggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgcaggttgcggtggacaaactacctccggccgggaatcaagcgcggcaactttaccgagcaggaggagaagctcatcgtccacctccaggctctccttggcaacaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcactggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgcagtgctccggtgagggcacggcgtctgcgtcggcgagccacagtggcggggcggccgcgaacacggcggcgcagacccccgagtgctcgacggagaccagtaagatggccggcagctcggtcggcgcgggctccgcgccggcgttctcgatgctggagagatggctgctggacgacggcatggggcacgctgaggtggggctcatgaccgacgtggtgccattaggggaccccagtgagttcttttaattaaggcacaagtaccaccaaaagcaaactgatcaagtagagatgcaagaacaaaaagaagaaattaatcgccgggttaggtaactagttaagcagaaatccaacaaaactaaatgtatttgaattctcggtgaatttgatcgagttggatgtcgatatagtttttgttttagtcccttcttttatttttttctctgttgtttctctgatgttagggtttgtaactgatcatgtaagcttatactaatgacaggttcctaaatggaccctgcatgaaaatacatcttataaattaaaagatctatacaaaaaaaaaaaaaaaaaa

SEQ ID NO: 1998 - protein, 302 aa, Zea mays
  G3540,MYB-(R1)R2R3 domain coordinates 14-118
MGRPPCCDKMGVKKGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKNMQGGEGGAGGKRPAVPKGQWERRLQTDIHTARQALRDALSLEPSATPLAKVEPLPTAPGCATYASSADNIARLLEGWLRPGSGKGPEASGSTSTTATTRQRPQCSGEGTASASASHSGGAAANTAAQTPECSTETSKMAGSSVGAGSAPAFSMLERWLLDDGMGHAEVGLMTDVVPLGDPSEFF

SEQ ID NO: 1999 - DNA, 1225 bp, Zea mays
  G3541,family:MYB-(R1)R2R3
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatgacccgctcctccaaggacagccacgctgcttgcccggccgacagcacaccagcggctgatgaggtcgtcacccagctcatcgcccagcagttcgccgccaccgacggcgacacctcgtcgtcgtcgtcctactcgtacgcctccagcacggacaacatctccaagctgctgaacggcttcatgatgaagagcgcctcgccggcgcgggacgacgctaccgacaccatcaagacttcctcggccattgacatcgaccctttcgaccacaagtccggcggggccgcactaccaccacccaagaagcggcagcagcagcagcatctgtcctccatagagaactggttgttcgacgatgccactgagcagctcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacaccaatatgcatgtttggttttatttacacaagcatgagccatgagacaagaacaatatatatgcatagttaatcaaaactcccaagcgagaggcacctcaaagaactcaaaaaa

SEQ ID NO: 2000 - protein, 289 aa, Zea mays
  G3541,MYB-(R1)R2R3 domain coordinates 14-118
MGRPPCCDKAGVKKGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRKQQAIGAIFAPPPPSEPTAGHADCRRHDMTRSSKDSHAACPADSTPAADEVVTQLIAQQFAATDGDTSSSSSYSYASSTDNISKLLNGFMMKSASPARDDATDTIKTSSAIDIDPFDHKSGGAALPPPKKRQQQQHLSSIENWLFDDATEQLVVQLMEEISGGSCSVPMLLY

SEQ ID NO: 2001 - DNA, 780 bp, Oryza sativa (japonica cultivar-group)
  G3542,family:CAAT
atggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaa

SEQ ID NO: 2002 - protein, 259 aa, Oryza sativa (japonica cultivar-group)
  G3542,CAAT domain coordinates 93-189
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 2003 - DNA, 762 bp, Oryza sativa (japonica cultivar-group)
  G3543,family:CAAT
ggtgacaatggacaaccagcagctaccctacgccggtcagccggcggccgcaggcgccggagccccggtgccgggcgtgcctggcgcgggcgggccgccggcggtgccgcaccaccacctgctccagcagcagcaggcgcagctgcaggcgttctgggcgtaccagcggcaggaggcggagcgcgcgtcggcgtcggacttcaagaaccaccagctgccgctggcgcggatcaagaagatcatgaaggcggacgaggacgtgcgcatgatctcggcggaggcgcccgtgctgttcgccaaggcgtgcgagctcttcatcctggagctcaccatccgctcgtggctgcacgccgaggagaacaagcgccgcaccctgcagcgcaacgacgtcgccgccgccatcgcgcgcaccgacgtgttcgacttcctcgtcgacatcgtgccgcgggaggaggccaaggaggagcccggcagcgcgctcgggttcgcggcgggagggcccgccggcgccgttggagcggccggccccgccgcggggctgccgtactactacccgccgatggggcagccggcgccgatgatgccggcgtggcatgttccggcgtgggacccggcgtggcagcaaggagcagcgccggatgtggaccagggcgccgccggcagcttcagcgaggaagggcagcaaggttttgcaggccatggcggtgcggcagctagcttccctcctgcacctccaagctccgaatagtgatgatccatatg

SEQ ID NO: 2004 - protein, 246 aa, Oryza sativa (japonica cultivar-group)
  G3543,CAAT domain coordinates 55-153
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 2005 - DNA, 753 bp, Oryza sativa (japonica cultivar-group)
  G3544,family:CAAT
atggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaa

SEQ ID NO: 2006 - protein, 250 aa, Oryza sativa (japonica cultivar-group)
  G3544,CAAT domain coordinates 89-185
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 2007 - DNA, 750 bp, Oryza sativa (japonica cultivar-group)
  G3545,family:CAAT
atggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggaggacgctgcagaggagcgacgtcgaggcggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatga

SEQ ID NO: 2008 - protein, 249 aa, Oryza sativa (japonica cultivar-group)
  G3545,CAAT domain coordinates 89-189
MDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 2009 - DNA, 806 bp, Glycine max
  G3547,family:CAAT
gggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcatctccagaacattagctgatgtgtcgtggaa

SEQ ID NO: 2010 - protein, 260 aa, Glycine max
  G3547,CAAT domain coordinates 89-185
MDHQGHSQNPSMGVVGSGAQLAYGSNPYQPGQITGPPGSVVTSVGTIQSTGQPAGAQLGQHQLAYQHIHQQQQHQLQQQLQQFWSSQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHPSQVGAAGVIMGKPVMDPNMYAQQSHPYMAPQMWPQPPDQRQSSPEH

SEQ ID NO: 2011 - DNA, 987 bp, Glycine max
  G3549,family:CAAT
gagaggatagttagaagattaaatcttaaagcagtaagtcatcatggataaatcagagcagactcaacagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttct

SEQ ID NO: 2012 - protein, 270 aa, Glycine max
  G3549,CAAT domain coordinates 93-189
MDKSEQTQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 2013 - DNA, 1126 bp, Glycine max
  G3550,family:CAAT
cttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttgtgatgagttacttttggttgtgtttactattggtgtagtggttaaattatttggcagctgtccataaccagagag

SEQ ID NO: 2014 - protein, 271 aa, Glycine max
  G3550,CAAT domain coordinates 94-190
MDKSEQTQQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVGSPADMPYYYVPPQHPVVGPPGMIMGKPIGAEQATLYSTQQPRPPVAFMPWPHTQPLQQQPPQHQQTDS

SEQ ID NO: 2015 - DNA, 1056 bp, Zea mays
  G3551,family:CAAT
aaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggtgaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaattgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctatagtaaaaaaaaaaaaaaaa

SEQ ID NO: 2016 - protein, 248 aa, Zea mays
  G3551,CAAT domain coordinates 87-187
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEVNKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 2017 - DNA, 778 bp, Zea mays
  G3552,family:CAAT
gagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcag

SEQ ID NO: 2018 - protein, 248 aa, Zea mays
  G3552,CAAT domain coordinates 87-183
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEENKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 2019 - DNA, 1141 bp, Solanum lycopersicum
  G3553,family:CAAT
ctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggccccactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtcctttaaaagtaaaacctgttgtaggtaaaaaaaaaaaaaaaacaa

SEQ ID NO: 2020 - protein, 230 aa, Solanum lycopersicum
  G3553,CAAT domain coordinates 62-158
MDQHGNGQPPVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 2021 - DNA, 1095 bp, Solanum lycopersicum
  G3554,family:CAAT
tatcaatcatctacctctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggccccactgagggtctgccattctattatggcatgccaccacaatctgctcaaccgattggagctccagggatgtacatgggaaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcact

SEQ ID NO: 2022 - protein, 271 aa, Solanum lycopersicum
  G3554,CAAT domain coordinates 90-186
MDQHGNGQPPGIGVVTSSAPIYGAPYQANQMAGPSPPAVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKACRSSSVCPAAPPIYGTANLAPAAATTLRFLSSSKLRLQESRS

SEQ ID NO: 2023 - DNA, 981 bp, Solanum lycopersicum
  G3555,family:CAAT
caccattacacctttcccattttctctacacagatagtagcttccattttccgcaaaccgccatggacaacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgaggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaatctgtgtggcagactggagacgataattcctatgctagtggaggtagcagtggacagggtaaccttgatggccaaatttaaaagatctcgctgctgccagtttggaggcttaacagcacatgtgaaactgatggttatgatagggaaatgtaatttcttcaaattgtgaatccaccttttatggcttctgtcatggatattgtttgactttaaccgacttgaaccttctgtctgtataaaacttgacttttgtgtatttctaaatttctcttctccaatccttttggggttgctaaaaaaa

SEQ ID NO: 2024 - protein, 232 aa, Solanum lycopersicum
  G3555,CAAT domain coordinates 54-150
MDNNPHQSPTEAAAAAAAAAAAAQSATYPSQTPYHHLLQQQQQQLQMFWTYQRQEIEQVNDFKNHQLPLARIKKIMKADEDVRMISAEAPVLFAKACELFILELTIRSWLHAEENKRRTLQKNDIAAAITRTDIFDFLVDIVPRDEIKDEGVGLGPGIVGSTASGVPYYYPPMGQPAPGGVMLGRPAVPGVDPSMYVHPPPSQAWQSVWQTGDDNSYASGGSSGQGNLDGQI

SEQ ID NO: 2025 - DNA, 922 bp, Arabidopsis thaliana
  G361,family:Z-C2H2
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 2026 - protein, 197 aa, Arabidopsis thaliana
  G361,Z-C2H2 domain coordinates 43-63
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 2027 - DNA, 1082 bp, Glycine max
  G3643,family:AP2
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 2028 - protein, 179 aa, Glycine max
  G3643,AP2 domain coordinates 13-78
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 2029 - DNA, 687 bp, Oryza sativa (japonica cultivar-group)
  G3644,family:AP2
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2030 - protein, 228 aa, Oryza sativa (japonica cultivar-group)
  G3644,AP2 domain coordinates 52-122
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 2031 - DNA, 656 bp, Brassica rapa subsp. Pekinensis
  G3645,family:AP2
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 2032 - protein, 144 aa, Brassica rapa subsp. Pekinensis
  G3645,AP2 domain coordinates 10-75
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 2033 - DNA, 649 bp, Brassica oleracea
  G3646,family:AP2
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 2034 - protein, 138 aa, Brassica oleracea
  G3646,AP2 domain coordinates 10-77
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 2035 - DNA, 495 bp, Zinnia elegans
  G3647,family:AP2
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 2036 - protein, 127 aa, Zinnia elegans
  G3647,AP2 domain coordinates 13-78
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 2037 - DNA, 594 bp, Oryza sativa (japonica cultivar-group)
  G3649,family:AP2
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 2038 - protein, 197 aa, Oryza sativa (japonica cultivar-group)
  G3649,AP2 domain coordinates 15-87
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 2039 - DNA, 813 bp, Zea mays
  G3650,family:AP2
ccacccgtgctcgatcgatcatgccatgtcaacgcccccggccgcgctgaccttgatccttctcgtctcaccgcaccttataaatacgcccacgtcgctcgtgtcgtcgtgtgctccatcgcaaacggccaaaaaccaccagcacaagtgcacaagccattgcccatcggacgcccagccggccagcccctgtcccgacggtcggccgacgacgatgagccgcgcagcgaccaacagcggcgcggagcggcggtgccggtacaggggcgtgcggcggcgggcctgggggaagtgggtgtcggagatccgggtgccgggcacgcgggagcggctgtggctgggatcctacgcggcgcccgaggccgccgccgtcgcgcacgacgccgccgcgtgcctcctccgcggctgcgcgggccgccgcctcaacttcccgggccgcgccgcctgctactacgcctgcggcgggcagcagccgctgtcgccgcgctccgtgcagcgcgtcgcgtccgacgccggcatggccgccgacgcgcagatcgtcgacgcgcgggcggccctcgcctcgccgccgcccgttgtccagcccgccgctctcgctggcattattggcggcgccgcgcgagaaggcggcggaggcgtgcgaggccccgcgtgcgcgccggcgccgccaagcaacggcgctggcagcagcagtacgtattggtccacgccgagcagtgagccgccgcttgtttacggggacattagcgtagacgacatagagatcttgatttgactattaggcactagttagtagcatagtcatggcagttc

SEQ ID NO: 2040 - protein, 249 aa, Zea mays
  G3650,AP2 domain coordinates 75-139
MSTPPAALTLILLVSPHLINTPTSLVSSCAPSQTAKNHQHKCTSHCPSDAQPASPCPDGRPTTMSRAATNSGAERRCRYRGVRRRAWGKWVSEIRVPGTRERLWLGSYAAPEAAAVAHDAAACLLRGCAGRRLNFPGRAACYYACGGQQPLSPRSVQRVASDAGMAADAQIVDARAALASPPPVVQPAALAGIIGGAAREGGGGVRGPACAPAPPSNGAGSSSTYWSTPSSEPPLVYGDISVDDIEILI

SEQ ID NO: 2041 - DNA, 702 bp, Oryza sativa (japonica cultivar-group)
  G3651,family:AP2
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2042 - protein, 233 aa, Oryza sativa (japonica cultivar-group)
  G3651,AP2 domain coordinates 60-130
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 2043 - DNA, 1146 bp, Zea mays
  G3656,family:AP2
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaa

SEQ ID NO: 2044 - protein, 200 aa, Zea mays
  G3656,AP2 domain coordinates 23-86
MEAEQAAMAAPQLGAAHQQTQPRRQYRGVRMRKWGKWVAEIREPHKRTRPRLRSYATAVAAARAYDTAVFYLPGPSARLNFPEEIPSFGLADGVDVGEHARDPAAAAAGGGGGCTLSAASIRKKAIEVGSRVDALQTGMVVPPPHHRERHRHHNHLPQLRVHAEEQQEEEEQKPQRPAWSGRVKNPDLNRAPSPESSDAE

SEQ ID NO: 2045 - DNA, 783 bp, Brassica oleracea
  G3659,family:AP2
caaaaatataatggcggcagaatccgactacattttgcttgagtcgataagacgacacttactaggagaatcggagtcgtggctcagtgagtcgacggcgagttcggtggttcaatctggtacgacggccaaaccggtgtacggaagaaaccctagcttcagcaagttgtacccttgcttcactgagagctggggacacttgccgttgaaagaaaacgacacggaggacatgttagtctacggtatcctcaacgacgcgtttcacggcggatgggaaccgtcgtcttcatcctccgacgaagaccagagctctaattttccgaaggttaaaaccgagaacttcacggtggtcgatcatgttccggcgaagaaggcgagtccggttaaggctccggagaaggggaagcattacagaggagtgaggcagaggccgtgggggaagttcgcggcggagataagggatccggcgaagaacggagctagggtttggttggggacgtttgagacggcggaagatgcagcgttggcttacgacagagctgctttcaggatgcgtggttcccgcgctcttttgaattttcctttgagggttaactcaggtgaacctgacccggttcgggttaagtcaaagagaggttcttcctctgaaatcggaggttcgaagcggagaagaacggtggcttctgtaaacggcggcggtcaaggaacagatatggggttgatggtcaagtgtgaggtggttgaagtgagacgtgacgatcatttacttgtcttatagttttt

SEQ ID NO: 2046 - protein, 255 aa, Brassica oleracea
  G3659,AP2 domain coordinates 130-194
MAAESDYILLESIRRHLLGESESWLSESTASSVVQSGTTAKPVYGRNPSFSKLYPCFTESWGHLPLKENDTEDMLVYGILNDAFHGGWEPSSSSSDEDQSSNFPKVKTENFTVVDHVPAKKASPVKAPEKGKHYRGVRQRPWGKFAAEIRDPAKNGARVWLGTFETAEDAALAYDRAAFRMRGSRALLNFPLRVNSGEPDPVRVKSKRGSSSEIGGSKRRRTVASVNGGGQGTDMGLMVKCEVVEVRRDDHLLVL

SEQ ID NO: 2047 - DNA, 703 bp, Brassica oleracea
  G3660,family:AP2
tctgtaataataatgtacggacatggcgagataaccacggcagcagaatcagattacgctttgctggagtcaatacgacgtcacttgctaggtggagacaacgagttacgattcagtgagtcaataccgagttcatgtttcactcagagttggggagacttgccattgaaagagaacgactccgaggatatgttagtgtacagtgtcctcaacgacgccttcaacggagcctttgaaacgtcgtcgccgtcgtcggacttgagctgtctcagcgattttaacgattttccggcggttaaaatggaaacttcggagaacttagcagcggaggcggaaaaaatgaaggcggtggcggcgccgccgtcaaagggaaagcattacagaggggtgagacagaggccgtgggggaaattcgcggcggagatacgtgatccggcgaaaaaaggagcgagggaatggttagggacgtttgagacggcggaagatgcagctttggcttacgatagagctgcttttaggatgcgtggttcccgcgctttgttgaattttccgttgagggttaactccggtgaacctgacccggtaaggatcaagtcaaagaggtcttataagtcttcttcgtcgtcctcttctgaaaacgggaagccgaagcagaggagaagaacagagaacgtgccatagttcaggtgaagggcgatgttgt

SEQ ID NO: 2048 - protein, 222 aa, Brassica oleracea
  G3660,AP2 domain coordinates 119-183
MYGHGEITTAAESDYALLESIRRHLLGGDNELRFSESIPSSCFTQSWGDLPLKENDSEDMLVYSVLNDAFNGAFETSSPSSDLSCLSDFNDFPAVKMETSENLAAEAEKMKAVAAPPSKGKHYRGVRQRPWGKFAAEIRDPAKKGAREWLGTFETAEDAALAYDRAAFRMRGSRALLNFPLRVNSGEPDPVRIKSKRSYKSSSSSSSENGKPKQRRRTENVP

SEQ ID NO: 2049 - DNA, 839 bp, Zea mays
  G3661,family:AP2
caggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagatcgtcgtctagtctagccatgcgccggagaaat

SEQ ID NO: 2050 - protein, 270 aa, Zea mays
  G3661,AP2 domain coordinates 126-190
MLLNPASEASVLDTIRQHLLEEPADESFGSLVADQWSGSLPFRTDDADDMVVFGALQDAFAYGWLPDGSFVHVKPEPVRSPDSSSYPCSYDGSPCFGLLDPEPPLTPGTTTPSSRGQEEAAAAMARGKHYRGVRQRPWGKFAAEIRDPARNGARVWLGTYDTAEDAALAYDRAAYRMRGSRALLNFPLRIGSGDKRPSPAPPEPATSSDSSSSSASGSHKRRKRGEAAAANMAMALVPPPSQLNRPAQPWFPAAPVEQAAMAPRVEQIVV

SEQ ID NO: 2051 - DNA, 855 bp, Lotus corniculatus var. japonicus
  G3663,family:ZF-HB
atggaaatgagagagatgccttccactttgatatataatctccccaacagagattcctcttctccatctctaccttcaagtagtgatcagccttctcaaactcacacaataatcttcaatcatccacctaaactttctcataaccaccaccatcatatttataccccttcttctacttctcctcctcttccaccaaactcagttcaacttcaacaacaacccacaagagatccagatccaagttcttcttcttctctattaattagatacagagaatgcctgaggaaccatgcagcgagattagggagtcatgtcacagatggatgtggcgagttcatgccaaatggagaacaaggaaccccagaatcattgatctgtgctgcttgcgagtgccaccgcaattttcacagaaaagaggctcaaggagaacctcaacaagtttccaactatcatcacaacaaaagcaatggtcagaacaggattcacccttcttctctgcatcataaacatggattttcttcgtcaccagggttgatgatgggctttgggggaggcagtggaggccctgcagctgaatcctcaagtgaagatctcaacatgtttcaccagtccaatgatggaggccaattatcagtgcagccaccactatcatcaaagaagaggttcagaactaagttcacccagcaacaaaaggacaggatgatggagtttgctgagaaactggggtggaagatccagaagcaagatgaagaggaagtgaagcaattctgctctcatgttggtgtaaaaagacaggctttcaaggtttggatgcacaatagcaagcaagcaatgaagaagaagcaaatcatgtaa

SEQ ID NO: 2052 - protein, 284 aa, Lotus corniculatus var. japonicus
  G3663,ZF-HB domain coordinates 88-141,219-282
MEMREMPSTLIYNLPNRDSSSPSLPSSSDQPSQTHTIIFNHPPKLSHNHHHHIYTPSSTSPPLPPNSVQLQQQPTRDPDPSSSSSLLIRYRECLRNHAARLGSHVTDGCGEFMPNGEQGTPESLICAACECHRNFHRKEAQGEPQQVSNYHHNKSNGQNRIHPSSLHHKHGFSSSPGLMMGFGGGSGGPAAESSSEDLNMFHQSNDGGQLSVQPPLSSKKRFRTKFTQQQKDRMMEFAEKLGWKIQKQDEEEVKQFCSHVGVKRQAFKVWMHNSKQAMKKKQIM

SEQ ID NO: 2053 - DNA, 1286 bp, Zea mays
  G3680,family:ZF-HB
tgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgctgctgcagcaccgtcattccacccgtccaggatcacccctccccctcccgtcctcacctcgtccccgacggccgccaccggcttcaacatcaacggcgccgcctcgtcggcgcccaccgtcgccaccgactacaccacggacaacgccaacggagcttcgtcgccgcactccgcttgaactagagaagggagaagagaggaggggggaagggaagggagagcggagagagagaaacatgtagcttaatttcagtgatcactcgttttttttttctttagacttcttgccatctactaagaaattaaccccaagaaaaagcatgccgctgtgcgccatgc

SEQ ID NO: 2054 - protein, 370 aa, Zea mays
  G3680,ZF-HB domain coordinates 34-89,222-285
MEAMDVKYKPVMFPNGAGLKKPKPAAAVALAGEPLYRECLKNHAASLGGHAVDGCGEFMPSPGANPADPTSLKCAACGCHRNFHRRTLEGSPPPPAPAPLALPPPPSVMHGQPHRAREETPEDRHPGVVDADDSDSDSEGSEYDEERSVSPPPPPHHLLPAPVAQQPPPPSYFPTAPHMVLSLGSGVPGPAVAVSPAQRLAPTQLTPSSAPPHAGGAMPMPRKRFRTKFTAEQKQRMQELSERLGWRLQKRDEAIVDEWCRDIGVGKGVFKVWMHNNKHNFLGGHSARRSASSPAPAPAAASLQTPAAGAGAAAAPSFHPSRITPPPPVLTSSPTAATGFNINGAASSAPTVATDYTTDNANGASSPHSA

SEQ ID NO: 2055 - DNA, 1098 bp, Zea mays
  G3681,family:ZF-HB
cgtcatgttccccaacggcgccgccttcaagaaggcgaagccggcggccgtggcgccggccggggagccgctgtaccgggagtgcctcaagaaccacgccgcgagcctgggcgggcacgccgtggacgggtgcggcgagttcatgccctcgccgggggccaaccccgccgacccgacgtcgctcaagtgcgcggcgtgcgggtgccaccgcaacttccaccgccggacggtggagggttccccgccgcagcctgcgcccgcgccgctggcgctcccgccgccgccgccgccgccgccgagcgtgctgcacggccagacgcaccgcggcggggaggatacgcccgaggaccgccacccgggggtagtcgacgccgacgaccccgattccgactcggagggctcggagtacgacgaggagcggtcagtgtccccgccaccgccgcaccacgtgccggcgccggtggcgcagcaacccccgccgccgtcatacttcccggcggcggcgccgcaccagcacatgctgctctcgcttggtcctggcgccgcggtggcggccgcggcgcagaggctggccccagcccagctgacgccgtcgagcgcgccgcctcccgggggcgcgatgcccaggaagcggttccgcaccaagttcaccgccgagcagaagcagcggatgcaggagctgtcagagcggctcgggtggcggctgcagaagcgcgacgaggccgtcgtggacgagtggtgccgcgacatgggcgtcggcaagggcgtcttcaaggtctggatgcacaacaacaagcacaacttcttgggcggacacagcgcccgccgcagcgtctctgcctcctcaggcgctgctgcgctcctccaaaccccatgcgccaacgccggcgctgctgcaccgtcattcaacccgtccaggctcacccctccccctcccgtcctcacatcgtccccgaccggcttcaacatcaacggcgccgcctcctcctcgccgcccaccgtcaccgccgaccacacggacaacgccaacggagcttcatcgccgcactccgcttaagctagagaggagagggaagcgagaatggagagacaaacatg

SEQ ID NO: 2056 - protein, 350 aa, Zea mays
  G3681,ZF-HB domain coordinates 22-77,208-271
MFPNGAAFKKAKPAAVAPAGEPLYRECLKNHAASLGGHAVDGCGEFMPSPGANPADPTSLKCAACGCHRNFHRRTVEGSPPQPAPAPLALPPPPPPPPSVLHGQTHRGGEDTPEDRHPGVVDADDPDSDSEGSEYDEERSVSPPPPHHVPAPVAQQPPPPSYFPAAAPHQHMLLSLGPGAAVAAAAQRLAPAQLTPSSAPPPGGAMPRKRFRTKFTAEQKQRMQELSERLGWRLQKRDEAVVDEWCRDMGVGKGVFKVWMHNNKHNFLGGHSARRSVSASSGAAALLQTPCANAGAAAPSFNPSRLTPPPPVLTSSPTGFNINGAASSSPPTVTADHTDNANGASSPHSA

SEQ ID NO: 2057 - DNA, 1026 bp, Oryza sativa (japonica cultivar-group)
  G3691,family:ZF-HB
atggaggccatggacgtcaagtacaagccgctcgtgttccccaacggcgccatcaagaaggcggcgaagccggcggcggtggcgcctgcggtgggcggcggcggagggggagagacggtgtaccgggagtgcctcaagaaccacgcggcgagcctgggcgggcacgcgctggacgggtgcggggagttcatgccgtcgccggcggcgaaccccgccgacccgacgtcgctcaggtgcgccgcgtgcggctgccaccgcaacttccaccgccggctgccggaggggtcccccccgccgccgccgccgccggcgctgctgcccgcgccgcccatgccgccgcaccgcggggaggagacgcccgaggtccgcctccccggggtggatggcgacgagtccgactccgactcggacgggtcggagtacgacgacgagcggtccgtgtccccgccgccgccgccgctggcggcggcggtggcgcaccaggtgtactacccttcggcgccgcacatgctgctgtcgctggggtcgagcgggcaggcgcagaggctcccgccgcaggtgatgtcgccggcggcggcggccgcgcctccccccggcggcggcggcggcgggatgccgaggaagcggttccgcaccaagttcaccgccgagcagaagcagcggatgcaggagctctcggagcggctcgggtggcgcctccagaagcgcgacgaggccatcgtcgacgagtggtgccgcgacatcggcgtcggcaagggcgtcttcaaggtctggatgcacaacaacaagcacaactacctcggcggccacagcgcccgccgcagcgcctcctcctcctccgccgccgccgccgccgccccgccattcaaccctcccacctcacctcctcctcctcctcctcctcctccacacgccaccgacttcaacatcaacggaacagccaccgccgccaccgccgccgccgccgccaccatcgccgccggcaaccaccaagagaacggagcatcgtcgccgcaatcagcataa

SEQ ID NO: 2058 - protein, 341 aa, Oryza sativa (japonica cultivar-group)
  G3691,ZF-HB domain coordinates 39-94,207-270
MEAMDVKYKPLVFPNGAIKKAAKPAAVAPAVGGGGGGETVYRECLKNHAASLGGHALDGCGEFMPSPAANPADPTSLRCAACGCHRNFHRRLPEGSPPPPPPPALLPAPPMPPHRGEETPEVRLPGVDGDESDSDSDGSEYDDERSVSPPPPPLAAAVAHQVYYPSAPHMLLSLGSSGQAQRLPPQVMSPAAAAAPPPGGGGGGMPRKRFRTKFTAEQKQRMQELSERLGWRLQKRDEAIVDEWCRDIGVGKGVFKVWMHNNKHNYLGGHSARRSASSSSAAAAAAPPFNPPTSPPPPPPPPPHATDFNINGTATAATAAAAATIAAGNHQENGASSPQSA

SEQ ID NO: 2059 - DNA, 774 bp, Arabidopsis thaliana
  G370,family:Z-C2H2
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 2060 - protein, 257 aa, Arabidopsis thaliana
  G370,Z-C2H2 domain coordinates 97-117
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 2061 - DNA, 798 bp, Glycine max
  G3717,family:AP2
ggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgt

SEQ ID NO: 2062 - protein, 251 aa, Glycine max
  G3717,AP2 domain coordinates 130-194
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIRDPAKNGARVWLGTFETAEDAALAYDRAAYRMRGSRALLNFPLRVNSGEPDPVRVTSKRSSSPESMAAAAPKRKKVMVVGTVQEQVGSQVVECTRGEQLLVS

SEQ ID NO: 2063 - DNA, 1013 bp, Glycine max
  G3718,family:AP2
cacgaaatgtacggacaaagtagctatgagtccgatttggcccttttggactccattcgccgccacttactcggcgactccgaggaacacagattcggagccccgaatgttaattcgggtagcactccattgtactctcggagctccagtttcggcaggttgtacccttgcctgagtaacgattggggcgaacttcctcttatggaagacgattcagaagacatgcttctttatggtgttcttcgcgacgccgtgaacgtaggctgggtcccatctctcgacgcttcctcaccggagagtttctcgtcggctttcatgccgccggtgaccgtgaaatccgaaacggatctatttccggcaccggaaccgatttgtaaccctccggtggttcagggcccggcgccggcggtagttccggcgaaagggaagcactaccggggcgtgcggcagcgaccgtggggaaaattcgcagcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagcccgaaccggttcgagttacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtt

SEQ ID NO: 2064 - protein, 240 aa, Glycine max
  G3718,AP2 domain coordinates 139-203
MYGQSSYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYDRAAYRMRGSRALLNFPLRINSGEPEPVRVTAKRASAEPCSSSESGSWVKKRKKVVG

SEQ ID NO: 2065 - DNA, 689 bp, Zea mays
  G3719,family:WRKY
ccaccatggccgatgactacttccagttcggattcgacggccaggagatggtgggcgctcccgctcccgcctgcggcggctacgactgctcggcgccggtgttcgccaacagttcttcagacgccgccgccgccgtcggcaatggcatgagcctgctgagctatggcgtcgacggcgacggcgacgggaggaggccgatgagcggaccaccatatggcaccggtgggaacggcggcggccggccgccgtcgtcgtcacggattgggttccggacgcggtcggaggtggacgtgctggacgatggcttcaagtggcgcaagtacggcaaaaagacggtcaagagcagccccaacccgaggaactactaccggtgctcggcggagggctgcggcgttaagaagcgcgtggagcgggacagcgacgacccgcgctacgtcgtcaccacctacgacggcgtccacaaccacgccgcgctgggcccgggcgccgcctcctacctgtgccaaccaccgcctccgcgcggcgcaaccgcaaccgcaaccgtaacgcccttctcgcctccacgctcggcctcggcgccggcgcccctggctgcagcgcccagctggagcgccgcctgtgacgcgtgggaggcgcagctgcacgccgcggcggcggctgctcattcctcggagtcgtcgtactgatcc

SEQ ID NO: 2066 - protein, 226 aa, Zea mays
  G3719,WRKY domain coordinates 98-154
MADDYFQFGFDGQEMVGAPAPACGGYDCSAPVFANSSSDAAAAVGNGMSLLSYGVDGDGDGRRPMSGPPYGTGGNGGGRPPSSSRIGFRTRSEVDVLDDGFKWRKYGKKTVKSSPNPRNYYRCSAEGCGVKKRVERDSDDPRYVVTTYDGVHNHAALGPGAASYLCQPPPPRGATATATVTPFSPPRSASAPAPLAAAPSWSAACDAWEAQLHAAAAAAHSSESSY

SEQ ID NO: 2067 - DNA, 666 bp, Zea mays
  G3720,family:WRKY
atggcggcagtcggagctcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 2068 - protein, 221 aa, Zea mays
  G3720,WRKY domain coordinates 135-191
MAAVGAHPVLYHHPAPAGDASSMSSYFSHGGSSTTSSSASSFTAALAPTTTALAEHFDISEFLFDDAAGAGVAGAPGVFADGAARPVVLPVPDAAGGGAIIGAAAGGAAAASEVPERPRTTRIAFRTRSEIEILDDGYKWRKYGKKSVKNSPNPRNYYRCSTEGCNVKKRVERDKDDPSYVVTTYEGMHNHVSPSTVYYASQDAASGRFFVAGTQPPGSLN

SEQ ID NO: 2069 - DNA, 825 bp, Oryza sativa (japonica cultivar-group)
  G3721,family:WRKY
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 2070 - protein, 197 aa, Oryza sativa (japonica cultivar-group)
  G3721,WRKY domain coordinates 96-152
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYFGRRLRCSSEG

SEQ ID NO: 2071 - DNA, 680 bp, Zea mays
  G3722,family:WRKY
agttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagag

SEQ ID NO: 2072 - protein, 213 aa, Zea mays
  G3722,WRKY domain coordinates 129-185
MHMALSSRSSFAADVLLPATMSYRQPCSGASSYLGSQPAAPFPSAAFGAVAQLDVFDCLSSDEGVGVPAAVPGAFAPPPPLMPAERVVPDAAAGYSSHTRSAAAVAGEGSRTTHRIAFRVRSDEDEVLDDGYKWRKYGKKSVKNSPNPRNYYRCSTEGCNVKKRVERDRDDPRYVVTMYEGVHNHVSPGTVYYATHDAASGRFFVAGMHQPGH

SEQ ID NO: 2073 - DNA, 625 bp, Glycine max
  G3723,family:WRKY
acatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcgtcggagaaagcaacctccagcgatgcaagtcatgggttcggtgatgcaacctccaacaccaacatgcatataaagtgccaaaatagtgggattaagggaaagaatgcagaagtgagtcaaaggataacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaat

SEQ ID NO: 2074 - protein, 196 aa, Glycine max
  G3723,WRKY domain coordinates 112-168
MDYYFGNLNPNPYYHHSAVVNMASPSSEFMLSDYLVLEDALVVDHHQESWSQSTETESSEKATSSDASHGFGDATSNTNMHIKCQNSGIKGKNAEVSQRITFRTRSQLEVMDDGYKWRKYGKKTVKSSPNPRNYYKCSGEGCDVKKRVERDRDDSNYVLTTYDGVHNHQTPSTAYYSQMPLLHSNHDWALHPSANS

SEQ ID NO: 2075 - DNA, 662 bp, Glycine max
  G3724,family:WRKY
cgcaccatagtctttgttttcatttactaccatatttagttatcagcaatggacttctactttggaaactctcctccttatcccaataattatgctcataattctcttaatatggctctatcttcccctgagattgcactatccgattatctcatgctcgatgactatgttgatcatcaagattctcgatcatcacaaagcaccgagtcatctgaaaaagcaaccttcaatgatgccactcacggattcagtactggtgcaacctctaagaataataacataaactgcaaaaatgggattaatgaaaacaaaggtggagtgggtccaaggatcgcgtttagaaccaaatcagagcttgagatcatggatgatggatacaagtggaggaagtacggcaagaagtccgtgaagagcagtcccaatctaaggaactactacaaatgttcaagtggaggatgcagtgtgaagaaaagggtggaaagggatagagatgactacagctacgtgataacaacatatgaaggtgtgcacaatcatgagagcccatttaccacatactacagccccatctccttcgtacattctgatactactttcaaatgacaccaacttcaaacccttttgggcatttacacctccctagcttaattatgtgccaagaa

SEQ ID NO: 2076 - protein, 184 aa, Glycine max
  G3724,WRKY domain coordinates 107-163
MDFYFGNSPPYPNNYAHNSLNMALSSPEIALSDYLMLDDYVDHQDSRSSQSTESSEKATFNDATHGFSTGATSKNNNINCKNGINENKGGVGPRIAFRTKSELEIMDDGYKWRKYGKKSVKSSPNLRNYYKCSSGGCSVKKRVERDRDDYSYVITTYEGVHNHESPFTTYYSPISFVHSDTTFK

SEQ ID NO: 2077 - DNA, 831 bp, Oryza sativa (japonica cultivar-group)
  G3725,family:WRKY
gccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctg

SEQ ID NO: 2078 - protein, 243 aa, Oryza sativa (japonica cultivar-group)
  G3725,WRKY domain coordinates 158-214
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 2079 - DNA, 729 bp, Oryza sativa (japonica cultivar-group)
  G3726,family:WRKY
taaatacggagctttcgcgccggcctcgtactcggccatggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgtacggttaatttgatcg

SEQ ID NO: 2080 - protein, 221 aa, Oryza sativa (japonica cultivar-group)
  G3726,WRKY domain coordinates 135-191
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 2081 - DNA, 663 bp, Zea mays
  G3727,family:WRKY
caagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgac

SEQ ID NO: 2082 - protein, 195 aa, Zea mays
  G3727,WRKY domain coordinates 102-158
MAASLGLNPEAVFTSYTSSPPFMSDYVAASFLPPAVVDSTDFSAELDDLHHHLDYSSPAPTLAGARSDRSEKQMIRWCEGGGGEKRLGRIGFRTRSEVEILDDGFKWRKYGKKAVKSSPNPRNYYRCSSEGCGVKKRVERDRDDPRYVITTYDGVHNHASPAAAAIIQYGGGGGFYSPPHSGSPSAASYSGSFVL

SEQ ID NO: 2083 - DNA, 1663 bp, Zea mays
  G3728,family:WRKY
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 2084 - protein, 205 aa, Zea mays
  G3728,WRKY domain coordinates 108-164
MATSLGLNPEDLFTSYSSSYYSSPPFMSDYAASFTPAAGDSTAFSSELDDLHHFDYSPAPIVTAAGAGAGGGDRNEKMMWCEGGGDERRLRSNGRIGFRTRSEVEILDDGFKWRKYGKKAVKNSPNPRNYYRCSSEGCGVKKRVERDRDDPRYVITTYDGVHNHASPGAAAIIVPYGSGGGNSGFYSPPHSGSPSATSYSGSLAF

SEQ ID NO: 2085 - DNA, 1091 bp, Oryza sativa (japonica cultivar-group)
  G3729,family:WRKY
aaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgat

SEQ ID NO: 2086 - protein, 246 aa, Oryza sativa (japonica cultivar-group)
  G3729,WRKY domain coordinates 137-193
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 2087 - DNA, 731 bp, Oryza sativa (japonica cultivar-group)
  G3730,family:WRKY
aaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttactt

SEQ ID NO: 2088 - protein, 219 aa, Oryza sativa (japonica cultivar-group)
  G3730,WRKY domain coordinates 107-163
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 2089 - DNA, 708 bp, Solanum lycopersicum
  G3731,family:WRKY
cgttccgttcaactatggaaaattttccctatagctcatcaaaccctaaccctaattttatcgacgcatcggagaattttgagctctccgattataattatctttttctcgatgatggatcgagtgacgattttttgtcacaaaatgaaattgttcaaagtgtttccgatactagtggttcatattcaaataatcctactccaacaagtcataacataaaatgtatgaaaggtataaagaaggtggatgcaaagtctaaggttgcatttagatttagatcagagttggaggtgttggatgatggatttaaatgtaggaaatatggcaaaaagatggtcaagaataatccaaatccaaggaattactacaaatgttcaagtgggggatgcaatgtgaagaaaagagtagaaagggacaataaagattcaagctatgtcattactacttatgaagggattcacaaccacgagagtcctcatgtgcttcactacacacaattccctcccaacaatattgcccttcacaatcttcacctttagaacctcttaaacgtgtcagtaaagtttagttatatatttgtattatggtaggttctaatggagcactttgattatatgataaagtgtttttattgaacattttcgacatatgttttaaaaaagttgtgcacgaattttcaagtgctaaatatatagataagttaatcgc

SEQ ID NO: 2090 - protein, 174 aa, Solanum lycopersicum
  G3731,WRKY domain coordinates 95-151
MENFPYSSSNPNPNFIDASENFELSDYNYLFLDDGSSDDFLSQNEIVQSVSDTSGSYSNNPTPTSHNIKCMKGIKKVDAKSKVAFRFRSELEVLDDGFKCRKYGKKMVKNNPNPRNYYKCSSGGCNVKKRVERDNKDSSYVITTYEGIHNHESPHVLHYTQFPPNNIALHNLHL

SEQ ID NO: 2091 - DNA, 743 bp, Solanum tuberosum
  G3732,family:WRKY
tttctatcttttctttcccttcaacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaacctcttaaacgtgtcagtaaatttcagttatatatttgtataatggtaggttctaatagagcactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 2092 - protein, 174 aa, Solanum tuberosum
  G3732,WRKY domain coordinates 95-151
MENFPYSSSNPNPNFIDASENFELSDYNYLFLDDGSNDDFLSQNEIVQSVSDSSGSYSNNPTPTSHNIKCMKGVKKVDAKSRVAFRFRSELEVLDDGFKWRKYGKKMVKNSSNPRNYYKCSSGGCNVKKRVERDNEDSSYVITTYEGIHNHESPYVFHYTQFPPNNIALHNLCL

SEQ ID NO: 2093 - DNA, 1387 bp, Hordeum vulgare
  G3733,family:WRKY
gaattcggcaccagggcgctcaccatcgccgaagcttctcagcgcgaagctcaccgggaagccgaccaaaatcccccgggaaaaaaagagagctctcacggccggcgccatctccaactagtacaaatctacccgccaaatccactccccaacccaatccatgcagcagcagcagcagcagcgcaccggcgatttagggggtcttatatattataaataggaagcgctctcgccggtgacaaactcggtcatggcggcagtcggagcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggccgcttcttcgtcgccggcacgcacccgccgccaggctccctcaactgagtagactagccaccaacgacggagcacgtcgagatcagcacgtacggggcttccatcttgggcaagctagccagctcgggcctcggtgccgtagcagccacaagttcgtagttaaactagtgcactactggttcaggttcggtttcccgactgtagtgttgtgtactgcggtgtgcactgtcggctcgatcaccaggttttatccctcgagcataattagtggatcgaaagagcccggccggggaacgtaactcagtccactactagtgctgcctacttaaccgtgtaataaaaatacccatgtgccgtttccctcagcccataggcctccgagagttccatgtttaagcaccaacatgcatcaaagagcatctaaaaaaagcatcaaagagatccatgtagaaaaagtttgtcgtattacccgacagaaaaaagtttgtagcatttttttggtaaataattttggaaggttttacagtt

SEQ ID NO: 2094 - protein, 218 aa, Hordeum vulgare
  G3733,WRKY domain coordinates 131-187
MAAVGAAPVLYQQQAQAVGDACFFSSMSSYFSNEAISSSCSSPASSFSAALGATPPAAPAISPDPASQFDISEYLYGDGPLAAPLAPVGAAVASSATAVPARSAAESAAAVERPRTERIAFRTRTEIEILDDGYKWRKYGKKSVKNSPNPRNYYRCSTEGCSVKKRVERDRDDPAYVVTTYEGTHSHASPSTVYYASQDAASGRFFVAGTHPPPGSLN

SEQ ID NO: 2095 - DNA, 653 bp, Medicago truncatula
  misc_feature (605)..(605): n is a, c, g, or t
  misc_feature (610)..(610): n is a, c, g, or t
  misc_feature (615)..(615): n is a, c, g, or t
  misc_feature (625)..(625): n is a, c, g, or t
  misc_feature (647)..(647): n is a, c, g, or t
  misc_feature (652)..(652): n is a, c, g, or t
  G3735,family:AP2
ctaatccttcatactaaagaaaacatagacttataacaaaaatattattatttacttcgtatatttttgtgtttcaaattaatggagggagatcataaattagtttcaaattcaacaaatggaaatggaaatggaaatggaaattcagatcaaataaagtatagaggaattcgtagaagaccatggggaaaatttgcagcagaaattcgtgacccaacaaggaaagggacaagaatatggcttggaacatttgatactgctgaacaagctgcaagagcttatgatgctgctgcttttcattttcgtggtcatagagctattctcaatttccctaatgaatatcaagctcctaattcatcttcttcattacctatgcctcttactatgcctccaccaccttcttctaatccacctccttcttcttcttcttcttcctctttttcttcttacaccgttgatgatggttttgatgagcttgaattcttggataataagttgcttcaagaacttcttcaagatggaacacaatagttaactattgaagatcaagtggcatgaaatgtattggtggtcatttaattttctcttcattaatttattttggnttggntatgnatctcatttntatgaataaatgagaatggggnattana

SEQ ID NO: 2096 - protein, 149 aa, Medicago truncatula
  G3735,AP2 domain coordinates 23-87
MEGDHKLVSNSTNGNGNGNGNSDQIKYRGIRRRPWGKFAAEIRDPTRKGTRIWLGTFDTAEQAARAYDAAAFHFRGHRAILNFPNEYQAPNSSSSLPMPLTMPPPPSSNPPPSSSSSSSFSSYTVDDGFDELEFLDNKLLQELLQDGTQ

SEQ ID NO: 2097 - DNA, 859 bp, Triticum aestivum
  G3736,family:AP2
gcacgaggcttcattctccctcgttccatccaagctccaccatccatcactgatttgcacttacctagctactccgcaacccccacttccggcttcttcatttctcactactagtacgtagttgagattatggagggcggagaaggatccggtggcggcggcgagccgaccaagtaccgcggggtgcgccgcaggccgtggggcaagttcgccgcggagatccgggactcgagccggcacggcgtgcgcatgtggctcggcaccttcgacaccgccgaggaggccgcggccgcctacgaccgctccgcctactccatgcgcggccgcaacgccgtgctcaacttccccgaccgggcgcacgtctacgaggccgaggccaggcgccagggccagggctcttcgtcgtcggcgaggcagcagaatcagcagcagcagcaggggcagagcggggtgatcgagttcgagtacctggacgacgacgtgctgcagtccatgctccacgaccacgacaaatccaacaagtagatcgatggatcatccatccatccatccatggatcgatccataatacctactgtatcatcccggcccggccggcaacatcgacctgcgtgcatgcgcgggcgcggatgcaatctacactacctacctatgcattccggccatatattaggtacgtagattatatgtgtacgagagcctacgagctcgatgaagatcgtacgtggtgcattctgatgcatgaggattccatcgacacgaccctctaccatatatttgatgggtcgatcgagtaatttgcagccagtaatccaatcgatgatatggggttttcaaaaaaaaaaaaaaaaaaaaaaaa

SEQ ID NO: 2098 - protein, 131 aa, Triticum aestivum
  G3736,AP2 domain coordinates 12-76
MEGGEGSGGGGEPTKYRGVRRRPWGKFAAEIRDSSRHGVRMWLGTFDTAEEAAAAYDRSAYSMRGRNAVLNFPDRAHVYEAEARRQGQGSSSSARQQNQQQQQGQSGVIEFEYLDDDVLQSMLHDHDKSNK

SEQ ID NO: 2099 - DNA, 882 bp, Oryza sativa (japonica cultivar-group)
  G3737,family:AP2
acacatgcatcgatcattcatggatgccgaattgccgcgatccgggcattatttcgcgccaggagacccaagatcatcgtgtcgcccacgctataaatagctagctagcttgcctttatgttgcatatgccaactgctacatgcaggacgtctgaaactatcattagtgacctgcagcgcctgcagtatatatatacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccggtcgtcggtacgctcgctgaaacgagacccggattgctatcaataagcaagcagaagaaaaccgtctcctatatatagcttcttctgttggcacaagcatatatgggcatgcatgacacatgctactgtgaattgacgggtgtgtgctgtgtgcagactactaaaccacgcttgcaagttgcacgtacgacgtggttgtcaagagcatgcagtccacgaagcagagaaaaacacctggtttatc

SEQ ID NO: 2100 - protein, 128 aa, Oryza sativa (japonica cultivar-group)
  G3737,AP2 domain coordinates 8-72
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 2101 - DNA, 899 bp, Zea mays
  G3739,family:AP2
cgatataattcactcctctcaacgctcgctgcacacacacaccagtgaacctagccagccatttgccgcatcgatcatcagtcgctgtcacgcgcgccaaaccaaaccaaagcccaaacccagctgcaagtgctactgacagcagctagcaaacacacacccgtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtggggggttacgttcaattgtatgcatgcagtgcagtgactaccggccggctctcctggatatgtcggccatctctctctatatattattaaaatgtcagctcccttctctaatttggcgggagttacatcagtggtactatgcagagttgcatacttgcatatatatgcacattattaattaataactcgatctctcgtggacggtggaacagtgataatcatctcattgtcaattaattttgatcaaagaaat

SEQ ID NO: 2102 - protein, 136 aa, Zea mays
  G3739,AP2 domain coordinates 13-77
MDGDWSKDGGGGEPTKYRGVRRRPWGKYAAEIRDSSRHGVRIWLGTFDTAEEAARAYDRSAYSMRGANAVLNFPEDAHAYAAACRGSGSSSSSSRHRQQQQQGSGRDVIELEYLDDEVLQEMLRNHEPSSSARKKM

SEQ ID NO: 2103 - DNA, 645 bp, Oryza sativa (japonica cultivar-group)
  G3740,family:HLH/MYC
atggccagcaacggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggaacggaggacgagaattagcgagaagctcaggaagctgcaggagctggtgcccaacatggacaagcaaacaagcacagcggacatgttggaccttgcagttgagcacatcaagggtctgcagagccagctgcaggctctgaagcatgagcaggagaagtgcacttgctgcagcaggccttga

SEQ ID NO: 2104 - protein, 214 aa, Oryza sativa (japonica cultivar-group)
  G3740,HLH/MYC domain coordinates 141-199
MASNGFPGSKGGGGSGAEAHHHPSMAGSGSGSSSGGRKMKSQLSFTAGPPHLSHIAEDGAFPDRAGAEASVPRTFSAGGSSGGGGFSIVGPWEESRDIISTLGGYESQFGGMASTSALEMAGMDRYLQLQHDQVPFKVRAKRGCATHPRSIAERERRTRISEKLRKLQELVPNMDKQTSTADMLDLAVEHIKGLQSQLQALKHEQEKCTCCSRP

SEQ ID NO: 2105 - DNA, 1110 bp, Oryza sativa (japonica cultivar-group)
  G3741,family:HLH/MYC
atgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccctagcaactacgaatctcagcttgttgcgcccagggagatggctggcgtagagaaatacctgcagatgcagcacgaccaggtgccattcagagtacgggccaagcgtggatgcgcgacgcacccacggagcatcgcagagagggagagaagaacgaggatcagcgagaagctcaggaagttgcaggccctggtgcccaacatggacaagcaaacgagtacttcagacatgctggacttagcagttgatcacatcaagggactgcagagccagctgcagactctgaaggaagacaaggagaaatgcacctgcagctgcaagcaagcatcaaggaacagaccagccgactaa

SEQ ID NO: 2106 - protein, 369 aa, Oryza sativa (japonica cultivar-group)
  G3741,HLH/MYC domain coordinates 288-346
MNPAPSRAPQRQQRGGEMSARYGGGLQFFADAPPAGVEGGAATARTFFPVPGGGGEQQPPERAMRQQHYGGGGSGAAEISLGHGHGHGGKHHFHQFGVEAKDGGGGGDQSGFLTRHNSSPPGFFSSPVMDNGFSSSARPAGSSLGEVRHGAMSSSSNNNKKMKAPLSFASSRQGSGGLSQISEDGIPDLTDSIHGAAHHHGRSEENVSTHDHVVRSFSSGGFSIGSWEDSNSIVFSTSTGKSGAHGNDDIIATPSNYESQLVAPREMAGVEKYLQMQHDQVPFRVRAKRGCATHPRSIAERERRTRISEKLRKLQALVPNMDKQTSTSDMLDLAVDHIKGLQSQLQTLKEDKEKCTCSCKQASRNRPAD

SEQ ID NO: 2107 - DNA, 834 bp, Oryza sativa (japonica cultivar-group)
  G3748,family:HLH/MYC
atgctgcagctgagcgagctgcaccggcaggccggcggcggcgaggaggacgggagcggcgcgttctcgccgctgccgctgttcacggaccggacgaacgtgccgccgcgggaggagatggagggcggcttcaagtcgcccaatgccgccgccggaggcgagcacgcgctgttcaacgggttcggcgtgcacggcggcagcggcggcgccgggcagccgccgttcggccagcttcggagggagaggatagcggagcggatgaaatcgctgcaggagctagtcccaaacgccaacaagacggacaaggcgtcgatgctggacgagatcatcgactacgtcaagttcctgcagctccaagtcaaggtgctcagcatgagccggctcggcggcgccgccggcatggcgccgctggtggcgagcatgtcgtcggaggggaacagcaacgggagcagcaatggcggcggtggcaaggcgagcaagggcggcaccggcggcgagggcggcggcggcggcggaggaggaggaggaggtggcaccggtggtgggatgcgggtgacggagcagcaggtggcgaagatgatggaggaggacatgggcacggcgatgcagtacctgcaggggaaggggctctgtctgatgccgatctccctcgcctccgccatctcgtcggcgacctcatcggcgtcgctcctctcccgcccgtccatccgccacgccggcgcgccgccgcagacgatgctcgatgccgccggcccgacctcgccggcggcgatgtctaacggcgatgacccacggcacgcaaaggcggacggcggcgccggcgggacgcaatga

SEQ ID NO: 2108 - protein, 277 aa, Oryza sativa (japonica cultivar-group)
  G3748,HLH/MYC domain coordinates 64-121
MLQLSELHRQAGGGEEDGSGAFSPLPLFTDRTNVPPREEMEGGFKSPNAAAGGEHALFNGFGVHGGSGGAGQPPFGQLRRERIAERMKSLQELVPNANKTDKASMLDEIIDYVKFLQLQVKVLSMSRLGGAAGMAPLVASMSSEGNSNGSSNGGGGKASKGGTGGEGGGGGGGGGGGGTGGGMRVTEQQVAKMMEEDMGTAMQYLQGKGLCLMPISLASAISSATSSASLLSRPSIRHAGAPPQTMLDAAGPTSPAAMSNGDDPRHAKADGGAGGTQ

SEQ ID NO: 2109 - DNA, 1392 bp, Oryza sativa (japonica cultivar-group)
  G3749,family:HLH/MYC
atgcaacccaacgcccgccaaatgcgcggcggcggcggcggcggcggcggcgggcaggacgacttcttcgaccagatgctgtccacgctgccggcggtgtggtccgagctcggctccggcaagcccgcctgggacctcacggccggcgccgtaggaggaggaggaggagcctccgatgaccactccgccgcggcgttcgacgactccgcgctcctcgcctcccgcctccgccagcaccagatcgacggtggaggcgacaagcccatcatgctccaactcagcgacctccaccgtcatcacggcctcgccgccggcgatgacagcggcggcgctgccgggttccttcccctgtcgctgttcgctgaccggtcgcaggacgacatcgacgccgccttcaagtcccccaatggcgctagaggtgaccatgcgctgtacaatgggttcggggccgccggaatgcatggcgccgccgccatgcagccgccgccgttcgggcagggaggatcaatgccggcgcagagcttcggtggcggagcggccgcgagcggcggcggcggcggcgggtcggcgtcggcggcagcggcggctggggcatcgtcgggcggaggggcggcggcgccgccgcggcagcggcagcgggcgaggagagggcaagccactgacccacacagcatcgccgaacgtgtataccactctcccaccacctttcccttctcgcccccattttttattgcctccatgccatgttgtctccggagggagaggatagctgagaggatgaaggcgttgcaggagctggtcccaaatgccaacaagaccgacaaggcatcgatgctcgacgagatcattgattatgtgaagttcctccagctccaagtcaaggttctcagcatgagcagattggggggagcttctgcagtcgcgcctctagtggctaacatgtcatcagagagtaatgggaatggcaatgccaccagcagcagcgggaacggcgaggcggccaatggcagcagcaacggcgacaacaatggtggcggcacactgcgggtgacggagcagcaggtggcgaagctgatggaggaggacatgggctccgccatgcagtacctgcaggggaaggggctatgcctgatgccgatctctctcgcaacggccatctcctccgccacctcctcgtcgctcctcccccgcactgggggaggcgctggagggtccctacatgaaggtggtaatggtacatcaccaccattggtgaatggcaccgccaccggatgtgacgacgccggagtattcttttctgttaaatttgtcgtggagctgtcgtttctcctgctgaatgaagactgtagaggtaaggaggaatcgaaattattggtccagaagggaccctga

SEQ ID NO: 2110 - protein, 463 aa, Oryza sativa (japonica cultivar-group)
  G3749,HLH/MYC domain coordinates 238-294
MQPNARQMRGGGGGGGGGQDDFFDQMLSTLPAVWSELGSGKPAWDLTAGAVGGGGGASDDHSAAAFDDSALLASRLRQHQIDGGGDKPIMLQLSDLHRHHGLAAGDDSGGAAGFLPLSLFADRSQDDIDAAFKSPNGARGDHALYNGFGAAGMHGAAAMQPPPFGQGGSMPAQSFGGGAAASGGGGGGSASAAAAAGASSGGGAAAPPRQRQRARRGQATDPHSIAERVYHSPTTFPFSPPFFIASMPCCLRRERIAERMKALQELVPNANKTDKASMLDEIIDYVKFLQLQVKVLSMSRLGGASAVAPLVANMSSESNGNGNATSSSGNGEAANGSSNGDNNGGGTLRVTEQQVAKLMEEDMGSAMQYLQGKGLCLMPISLATAISSATSSSLLPRTGGGAGGSLHEGGNGTSPPLVNGTATGCDDAGVFFSVKFVVELSFLLLNEDCRGKEESKLLVQKGP

SEQ ID NO: 2111 - DNA, 885 bp, Oryza sativa (japonica cultivar-group)
  G3750,family:HLH/MYC
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcattagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctag

SEQ ID NO: 2112 - protein, 294 aa, Oryza sativa (japonica cultivar-group)
  G3750,HLH/MYC domain coordinates 136-193
MAGQQPQQQGPPEDDFFDQFFSLTSSFPGAAPGGRAAGDQPFSLALSLDAAAAAEASGSGKRLGVGDDAEGGGSKADRETVQLTGLFPPVFGGGGVQPPNLRPTPPTQVFHPQQSKQGGAAVGPQPPAPRPKVRARRGQATDPHSIAERLRRERIAERMRALQELVPNTNKTDRAAMLDEILDYVKFLRLQVKVLSISRLGGAGAVAQLVADIPLSVKGEASDSGGNQQIWEKWSTDGTERQVAKLMEEDIGAAMQFLQSKALCMMPISLAMAIYDTQQTQDGQPVKHEPNTPS

SEQ ID NO: 2113 - DNA, 1575 bp, Oryza sativa (japonica cultivar-group)
  G3751,family:HLH/MYC
atgggcggcttcgcctaccccttcacgccgtcgccggcgtggtcgcgggacgccgtgttcgctggctcgccgtgggccgcaggcggcgtctcctccctcgccgacgctttggtgagctacggtgccgtcgacgacgaggaggccgcgttcctcggcaagaccgccgcgtcgtctcccagtacggcgaggctgcacgagcagcagcagctgctgctggaggctgagctgctgcgccacggcgacggcctcggcttcgccgcgatggacgacgacggcggcgccgcgatgctcggcgcgctggagccgtgcgccatgccgctcaccgacagcggcggccccccggtcatctgcagcagcagctccaacgacagcagcgggagcgagcactccgccgccatgcctgcaggaggcggcttcctcgtcggagagcagcagcagcacgtgccgccggcggcctacgccgcgggaggtgtactcccgtccatggccgcgggagaagaaacgccgcagagcttcggctttggcagcctcttcaatggcgatctcctgcaggaggcgaccgtgagcaagtatcatcatcatcagcagcagcagcagctgggcgttgtgccttcgtcgcagccgcatcatctgaatgatgacatcgatttcaacactggaaaattgatgtcttttgcttctggacagcagcacgttacccccagcattgacagcctgcagatcgaccagaaggaattcagcagtggcctgcaccacctcaatctctcctcgctgatttctggaccactcgcatcattcaatgcaacacagagccatagacagcctgctgaagcttgcggtggcaaaaatggcggcgccgctccatttgtgaacctatctgaggtgctaccaaagggcaatgggagtggtagtgctgggaatggagcacccaagcctcgtgtcagggctcgccgaggccaggccaccgatccccacagcatcgcagagaggctccggagggagaagatctctgacaggatgaaggatttacaggagcttgtcccaaactcaaacaagactaacaaggcatccatgctcgatgagatcatcgactatgtgaaatttctccaattacaagtcaaggtccttagcatgagcaggcttggagcggccgaagccgttgtccctcttctgacagaaacacaaaccgagagccccgggtttctcctgtccccaagatcatcatcaggagaaaggcaggcaggagcaggagcagtaacaggagggctccccggcgatcagccggagctcctggacggcggcgccatgttcgagcaggaggtggtgaagctgatggaggacaacatgacgacggcgatgcagtacctgcagagcaaggggctctgcctcatgccggtggcgctggcgtcggcgatatcggcacagaaggggacgtcctcggccgccgtccgaccggagaagaagaagaacggtgatggcgatggcggcggcgacgaggaggacgtgaagggagagtttgacgcaccgaggaggcctcctgtcggccggccgaaggagatgaggtccagagtctaa

SEQ ID NO: 2114 - protein, 524 aa, Oryza sativa (japonica cultivar-group)
  G3751,HLH/MYC domain coordinates 317-374
MGGFAYPFTPSPAWSRDAVFAGSPWAAGGVSSLADALVSYGAVDDEEAAFLGKTAASSPSTARLHEQQQLLLEAELLRHGDGLGFAAMDDDGGAAMLGALEPCAMPLTDSGGPPVICSSSSNDSSGSEHSAAMPAGGGFLVGEQQQHVPPAAYAAGGVLPSMAAGEETPQSFGFGSLFNGDLLQEATVSKYHHHQQQQQLGVVPSSQPHHLNDDIDFNTGKLMSFASGQQHVTPSIDSLQIDQKEFSSGLHHLNLSSLISGPLASFNATQSHRQPAEACGGKNGGAAPFVNLSEVLPKGNGSGSAGNGAPKPRVRARRGQATDPHSIAERLRREKISDRMKDLQELVPNSNKTNKASMLDEIIDYVKFLQLQVKVLSMSRLGAAEAVVPLLTETQTESPGFLLSPRSSSGERQAGAGAVTGGLPGDQPELLDGGAMFEQEVVKLMEDNMTTAMQYLQSKGLCLMPVALASAISAQKGTSSAAVRPEKKKNGDGDGGGDEEDVKGEFDAPRRPPVGRPKEMRSRV

SEQ ID NO: 2115 - DNA, 1862 bp, Oryza sativa (japonica cultivar-group)
  G3752,family:HLH/MYC
acactttctgtttctagaggccattctctgtaacactttggagcatcaattttgtagcgtgctatcatggactactctgctggttcctacatgtggcctggcaattcaggttctgagaactataattttgttgacggttcgtcggaatcatatgcagaagaaggaagcctaccaccttcaggctatttcatgggagctggatcagatcgcagtttaaagatcacggagaatgaaaggaaccccactatgcttgcaaatggatgcttgccatacaacacccaggctcatccattatctggccagattctacctaagggtgagctccctaacaatcttctggatcttcaacagctacagaacagcagcaatctgcgaagcaattcaattcccccaggggttcttcagtgcaattcaacatctggaacatttgatgcgaaattggatacacctggtcttgcagaactgcctcatgctttgtccagttcaattgatagcaatggtagtgacatttctgcttttcttgctgatgtgcatgccgtttcttcagccccgacgttgtgttcagcattccaaaacgtttcctccttcatggaaccagtaaatctagatgctttcggtttccaaggggcacaaaatgttgctatgttgaacaaaacaagtcttccaaatgggaatccctcgctgtttgataatgctgccatagcatcactacatgatagcaaagagtttctcaatggtggttccatcccttcgtttggtactgtcctgcaggcactaggagcgggtggtttgaaggctgctcaacaggagcaaaatatccggaatatacctctccctacattcacatctggtagtcatttggcagttactgatgcacaagggccaccacttccttcaaagataccaccattgatccatgaccataatagtgagtaccctattaaccattcttctgatgtggaaccccaagcaaattcagctcctggaaatagtgccaatgcgaagccacgtacaagggctcgccgtggacaggcaactgatcctcacagtattgctgaacggcttcgccgagagaaaatttcagaaaggatgaaaaatctccaagtccttgtcccaaactccaataaggcagataaggcatcaatgcttgatgaaataattgattatgtgaaatttcttcagcttcaggtcaaggtattgagcatgagcaggctaggagctcctggagcagttcttccccttcttagggaatctcaaaccgagtgccatagtaatccatctctatcagcttcaaccatttcacaagggccaacagacatgccagactcagaagacagctctgcctttgagcaagaggtagtgaagctgatggaaacgagcatcatcagcgcgatgcagtatcttcagaacaagggtctctgcctgatgcccattgctctcgcttcggccatatccaaccagaaaggcatggctgctgctgctgcaatccctcctgaaaaatgaaaaaaaaaatgaaatcggaaaaatatggggggaacaactgcagaagacataataactcaacggctgcagaaatgtgctggacactgcaggttttgtgaatgaagtgaaatccaatccagggggtcataaaacataggaagttatctgactaattcaggcttatgacacaatctactctatagtctatagctattgtgtgcctgttgcacatcagttgatgtgtattcttttgttttttttgtattgcatccggatgctaattaggtagtagtgtttcctttgatgtacatgagtattatctatgcggttttatctaatgtgcatataaagtaaaatctggtaaaaaaaaaaaaaaaaaa

SEQ ID NO: 2116 - protein, 478 aa, Oryza sativa (japonica cultivar-group)
  G3752,HLH/MYC domain coordinates 319-376
MDYSAGSYMWPGNSGSENYNFVDGSSESYAEEGSLPPSGYFMGAGSDRSLKITENERNPTMLANGCLPYNTQAHPLSGQILPKGELPNNLLDLQQLQNSSNLRSNSIPPGVLQCNSTSGTFDAKLDTPGLAELPHALSSSIDSNGSDISAFLADVHAVSSAPTLCSAFQNVSSFMEPVNLDAFGFQGAQNVAMLNKTSLPNGNPSLFDNAAIASLHDSKEFLNGGSIPSFGTVLQALGAGGLKAAQQEQNIRNIPLPTFTSGSHLAVTDAQGPPLPSKIPPLIHDHNSEYPINHSSDVEPQANSAPGNSANAKPRTRARRGQATDPHSIAERLRREKISERMKNLQVLVPNSNKADKASMLDEIIDYVKFLQLQVKVLSMSRLGAPGAVLPLLRESQTECHSNPSLSASTISQGPTDMPDSEDSSAFEQEVVKLMETSIISAMQYLQNKGLCLMPIALASAISNQKGMAAAAAIPPEK

SEQ ID NO: 2117 - DNA, 969 bp, Zea mays
  G3753,family:HLH/MYC
atgctgtttcttcagcgtcaggctttgtgttccacattccaaaatgcttcttcattcatggaaccagtaaatctagaagctttcagttttcaaggggcacaaagtgattctgttttgaacaaaacaacccatccagatgggaatatctcagtatttgacagtgctgccttggcatcactacatgatagcaaagagtttatcagtggtaggctcccctcatttgctagtgtccaggaaacaaacgtagctgctagtggtttcaagactcagaagcaggagcaaaatgcagtgtgcaacgttcctatccctacgttcactgcacgtaatcaaattgcagttgctgcaatgcccggatcactgatccctcaaaagattccttcatggatcaatgaaaacaaaagtgagggtcctgttagccatccttctgatgtacaaatccaaccaaattcagttggaaatggtgttggtgtgaagccacgagtaagggctcgtcgtggacaggcaactgatcctcatagcattgctgaacgacttcgcagagaaaaaatttcagataggatgaaaaatctacaagatcttgtcccgaattctaataaggcagacaaggcatccatgctggatgaaatcattgattatgtgaaatttcttcagcttcaggtcaaggtgttgagcatgagtaggctaggagctccaggagcagttcttccccttctcgcagaatctcagactgagggttaccgcggtcaacttctgtcagctccaaccaacgcacaaggattactggacacggaagaatcggaagacaccttcgccttcgaggaagaggttgtgaagctaatggaaaccagcatcacaagcgcaatgcagtaccttcagaacaagggactctgcctgatgccagttgcccttgcttccgccatatccacccagaagggcgtctccgccgcgtcaatccctcccgaacagtga

SEQ ID NO: 2118 - protein, 322 aa, Zea mays
  G3753,HLH/MYC domain coordinates 164-221
MLFLQRQALCSTFQNASSFMEPVNLEAFSFQGAQSDSVLNKTTHPDGNISVFDSAALASLHDSKEFISGRLPSFASVQETNVAASGFKTQKQEQNAVCNVPIPTFTARNQIAVAAMPGSLIPQKIPSWINENKSEGPVSHPSDVQIQPNSVGNGVGVKPRVRARRGQATDPHSIAERLRREKISDRMKNLQDLVPNSNKADKASMLDEIIDYVKFLQLQVKVLSMSRLGAPGAVLPLLAESQTEGYRGQLLSAPTNAQGLLDTEESEDTFAFEEEVVKLMETSITSAMQYLQNKGLCLMPVALASAISTQKGVSAASIPPEQ

SEQ ID NO: 2119 - DNA, 1011 bp, Zea mays
  G3760,family:HLH/MYC
atgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggtgccgccttccttttgtggaccgtgcgtgtgtgtgttgtgctcggggggtcgaggcggcgtggcggtcgcggccgggagcgatga

SEQ ID NO: 2120 - protein, 336 aa, Zea mays
  G3760,HLH/MYC domain coordinates 243-300
MQPTTREMQAMAAAGQQISLDDLRAAAGGVHDDFLDQMLGGLPPSAWPELSSAAGGKAPDGGAQAEQMQHQPQHLGGGGGLYDDSALLASRLRQHQISGGGGGEAVKQMVLQQLADLRQEHHVLLQGMGRSTSTGGSRDGGLLLPLSLGSGGSGGDVQALLKAVADSAGGEAAGVFGGSFAGSLHHHQQQQQHFQSHPQQQTAPLPGQGFGGGAGASGGVSQPQAGAACGGAAAPPRQRVRARRGQATDPHSIAERLRRERIAERMKALQELVPNANKTDKASMLDEIVDYVKFLQLQVKVLSMSRLGGAAFLLWTVRVCVVLGGSRRRGGRGRER

SEQ ID NO: 2121 - DNA, 711 bp, Glycine max
  G3763,family:HLH/MYC
atggcaaatcttgcagcagcattgagagatgtggcaagttttaggggctgtgatgtctcaaatggacaagctattacatcctctagtggattgcatggtactttgaacttctcatctaggccatcctcttgctccacccggatgccacagattgctgaaaatggaaatgaagatgtggaagcaaattgtgttgaaagtagaaacctgagaaatgacaatatcaacaccactaaatgttacatgcctagtttcaccactgacttctgggatggttctgcattcagtgcctccagaacagctagtaacagaggtgaaatctcattttccacttcaaaggctatggatattcaggatgaagattttggataccaaaaagttggtttgacccaccatttgagtctgcctggctcttccagtaggatggctacaatggagaagctttatcaaattcaaggatctgttccatgtaaaattcgtgccaagagaggttttgccactcacccgagaagtattgctgaaagggaaaggagaacacgaattagcgcaagaatcaagaaattgcaagaccttttcccaaaatcagacaagcaaacaagcactgcagatatgttggatttggcagttgagtacattaaagacttgcagaaacaagttaagattctcagagatactagggcaaattgcacttgtacaagcaatcagaagcactga

SEQ ID NO: 2122 - protein, 236 aa, Glycine max
  G3763,HLH/MYC domain coordinates 161-219
MANLAAALRDVASFRGCDVSNGQAITSSSGLHGTLNFSSRPSSCSTRMPQIAENGNEDVEANCVESRNLRNDNINTTKCYMPSFTTDFWDGSAFSASRTASNRGEISFSTSKAMDIQDEDFGYQKVGLTHHLSLPGSSSRMATMEKLYQIQGSVPCKIRAKRGFATHPRSIAERERRTRISARIKKLQDLFPKSDKQTSTADMLDLAVEYIKDLQKQVKILRDTRANCTCTSNQKH

SEQ ID NO: 2123 - DNA, 1356 bp, Glycine max
  G3764,family:HLH/MYC
atgagtgttatgtatagtcctgttctcaattactcagatgtggagcatcagctaaggaaaaatcaagacatggattcaagtattggacatccacaacaacactgtcaccaacccaattctggactattgaggtattgttctgctccaagctcattgctggcaagcctcattgacaacaccattcatggctgtgtcaacgaggaatcgttcacaagtgagaatcatcatcatcatcagcagcagcagcagcagcattatcttccatctacaagttcagaaatggagaccatgttatccaaattgctaccatccaacaatggatggagcaattcagaagctttgcaagaatttggaggcaagccctgtgaagcaggaaataggggaatctattccacaagagccaccacaacagaatggttattcttatggtggctctcagttgatttaccaatctcagcaaattcaaggccttgccaaatggtggatcttccagtggcttctggcagtgcttttgatggctcttttggtgtggtgcactccatggcttcagaggactccattcaatctaaaatgggtatcaggaattgctccaatctctttaggcaaaagagttcccctgctgcatttttctccattgaaaatgatcttgcagcattgagagaagtaggaagctttaaagccgatgatgtttcaaatggactagttactgcatcaactggtgggttgcatagttctcatactttctcatctaggccatcttcatgcttgaaacggttgccacaaatagccgaaaatggaaatgaaagcctagaagaaaattgtgaccaaagtagaaacctagtaaatgacaatggtagctcaaaatgttacatacctagcttcaccaatgaattatgggaaagttctgcattcaatgccccaaaaacagagaatgaagatgaaatcatgttttccacttcaaatattttggaatctcaggaagcagatttcagctttcaaaatctgggtttgactcaccatttgagtctacctagctcttctactaagatgtcatccatagaaaagtttcttcagattcaaggttctgttccttgtaaaattcgagccaaaagaggctttgccactcacccaagaagtattgcagagagggtaagaagaacaagaattagtgaaagaatcaagaaactgcaagacctttttccaaaatcagaaaagcaaacaagcacagcagatatgttagatttggcagttgagtatattaaggacctgcagcaaaaagttaagatactctcagattgtaaggcaaagtgcaaatgtacaagtaatgagaagcattacactagaacttgtgcttga

SEQ ID NO: 2124 - protein, 451 aa, Glycine max
  G3764,HLH/MYC domain coordinates 370-428
MSVMYSPVLNYSDVEHQLRKNQDMDSSIGHPQQHCHQPNSGLLRYCSAPSSLLASLIDNTIHGCVNEESFTSENHHHHQQQQQQHYLPSTSSEMETMLSKLLPSNNGWSNSEALQEFGGKPCEAGNRGIYSTRATTTEWLFLWWLSVDLPISANSRPCQMVDLPVASGSAFDGSFGVVHSMASEDSIQSKMGIRNCSNLFRQKSSPAAFFSIENDLAALREVGSFKADDVSNGLVTASTGGLHSSHTFSSRPSSCLKRLPQIAENGNESLEENCDQSRNLVNDNGSSKCYIPSFTNELWESSAFNAPKTENEDEIMFSTSNILESQEADFSFQNLGLTHHLSLPSSSTKMSSIEKFLQIQGSVPCKIRAKRGFATHPRSIAERVRRTRISERIKKLQDLFPKSEKQTSTADMLDLAVEYIKDLQQKVKILSDCKAKCKCTSNEKHYTRTCA

SEQ ID NO: 2125 - DNA, 861 bp, Glycine max
  G3772,family:HLH/MYC
atgtatccctcttcctcttcctcctcctcctcttcctctcagtccatgacccaagctggcctcactcgctacggttccgcccccggttctcttctcaccagcacggttgattctcttattggtggatcccgtcccagtccctacttttccggagagtcttctgagtctccctgcaaagagcaaagatctttccacaaccaccccccctccttcgcttcctccttgctccgccagaaaagctctcccgccggcttcctttcccatctctccaatcaccatggtgtgggtttcaccatcacccccggtggtttatcaaattcaaattcaaattcaaattgttctctcttgaagtctcaactcagcttcacccacgaatctctttccaacactgttaatgttgatccctccagcaccaccttcggaatggatccctgggacaacaattccatcgccttttctgcaacttcaaccaagcgctccaaaaccaacaccaatgatcctgacattttacattccctgaattcggccttggaatcacagttcaatcttccacatacaagtctggaaatgtcaaccgtggacaagctattgcacattcctgaagattctgtcccttgtaaaatccgtgctaagcgaggttgtgctactcatccccgtagcattgccgagcgggagagaagaacaaggatcagtggcaagctcaagaaattacaggaccttgtacccaatatggataagcaaacaagctatgcagacatgctcgatttggccgttcaacacattaaaggtcttcaaactcaggttcagaagcttcacaaagaaatggagaattgcacttgcggatgcaaacaaagcaaataa

SEQ ID NO: 2126 - protein, 286 aa, Glycine max
  G3772,HLH/MYC domain coordinates 211-269
MYPSSSSSSSSSSQSMTQAGLTRYGSAPGSLLTSTVDSLIGGSRPSPYFSGESSESPCKEQRSFHNHPPSFASSLLRQKSSPAGFLSHLSNHHGVGFTITPGGLSNSNSNSNCSLLKSQLSFTHESLSNTVNVDPSSTTFGMDPWDNNSIAFSATSTKRSKTNTNDPDILHSLNSALESQFNLPHTSLEMSTVDKLLHIPEDSVPCKIRAKRGCATHPRSIAERERRTRISGKLKKLQDLVPNMDKQTSYADMLDLAVQHIKGLQTQVQKLHKEMENCTCGCKQSK

SEQ ID NO: 2127 - DNA, 1428 bp, Glycine max
  G3774,family:HLH/MYC
atgcaaccctgtagcagagaaatgcaaggcctcaactccctcttaaactcttcctcccaaatctccctccaagaccttcaaaatcacaccactaaccagatccaaaattcacacatgaaccaccaacaccaacttgctcactttgattcaacttctcacgacgactttctcgaacaaatgctctcttcctgctcttggacagacctcaacccaaacaagcccttattatgggaccctaacaccctcaacgacatcaagccccccgacgaaacgacgccgtccaacaacaacaacgacgctactactaatgtcgcatctttttcctccttcgatgagcactccaccttagcctccaagttccgcaaccaccagatcagctccaataacaacgcgcccaaaaacgccgcggcggcggctctcatgctccaacaccaactcctcagagactctggtcttctcaacatgcctctttccttgcccggaaacgacgtcgtggttgacgcttctaccttcgaatcccccaatccgagtggtaaagcttcagtccaaactttctacaacgggttcgccggatctctgcatggcgtaggccaatcctcgaaccagactcaacattttcaacaccctcagggaagttcgaatccgatgcaagggcaaaattttggggcggtgccagctggtggtggtagcgcgacgaatcaggctccagcgagtggcgctgccgcgggtggcgcgccggctcagccgaggcagagggttcgagcgaggagaggtcaagccacggacccacacagcatcgctgaaaggttacgtagggagagaatcgccgagagaatgaaggccctacaagaactggttcccaatgccaacaagacagacaaggcatccatgctagatgagatcatcgattacgtgaagttcctgcagctccaagtcaaggttctgagcatgagcagattgggcggtgctgctgctgtcgctccccttgttgctgatatgtcctctgagggaggcggagactgcattcaagccaacggcaagagtaacggcggtggggcccaggcttcaaccaccaacaccaacaccaaccaaacgacagcgacaacaacctcaaacgatagcctaacgatgacggagcaccaggtcgcgaaactaatggaagaagacatgggttcggctatgcagtatcttcaaggaaaaggtctttgcctcatgccaatttcacttgccactgcaatctccactgccacgtgtcccaccaggaacgttaacgttaaccccttgatcaacgccgccgccggagccacccattttccgaccgcagccaaccccgccggcgaagggccgtcgtctccgagcatgtccgtactgacggtgcagtccgccatcgcaggcaacgacggcgccgcctccgtttcgaagccgtga

SEQ ID NO: 2128 - protein, 475 aa, Glycine max
  G3774,HLH/MYC domain coordinates 256-313
MQPCSREMQGLNSLLNSSSQISLQDLQNHTTNQIQNSHMNHQHQLAHFDSTSHDDFLEQMLSSCSWTDLNPNKPLLWDPNTLNDIKPPDETTPSNNNNDATTNVASFSSFDEHSTLASKFRNHQISSNNNAPKNAAAAALMLQHQLLRDSGLLNMPLSLPGNDVVVDASTFESPNPSGKASVQTFYNGFAGSLHGVGQSSNQTQHFQHPQGSSNPMQGQNFGAVPAGGGSATNQAPASGAAAGGAPAQPRQRVRARRGQATDPHSIAERLRRERIAERMKALQELVPNANKTDKASMLDEIIDYVKFLQLQVKVLSMSRLGGAAAVAPLVADMSSEGGGDCIQANGKSNGGGAQASTTNTNTNQTTATTTSNDSLTMTEHQVAKLMEEDMGSAMQYLQGKGLCLMPISLATAISTATCPTRNVNVNPLINAAAGATHFPTAANPAGEGPSSPSMSVLTVQSAIAGNDGAASVSKP

SEQ ID NO: 2129 - DNA, 918 bp, Zea mays
  G3794,family:AP2
attacttgtgcacttgggtgcagtgcctgcagtataatcaagttagggtttaaaagaacctcgaccgcgatcgtatatagatccagattatcattagttattagaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgtgttgaaactgattatgaccaggcgatcgatcccatcttgtgcatgcggcctgccaaagttgctgggtcttctcatcgacctatatatatatgcttctcgatccatatatatatcataaatgcatgcagggtgcatgcatgtaccaagtttggaattataatgctcttggtgctgaattgaagtatactagtatatatagtgtgatccatgtattgaaaaggttgttttgcttaatcgcgtcatgattgcacacgtgcttgtttctgcttaaacaacccatatatatagccggctctggcctttgtcaagtctgcaatccttatacatcgttggtaattcatgcatgagttctatgtaactgcaatttagataaattgtagctaatataatagtc

SEQ ID NO: 2130 - protein, 124 aa, Zea mays
  G3794,AP2 domain coordinates 6-70
MDDGGEPTKYRGVRRRPSGKFAAEIRDSSRQSVRMWLGTFDTAEEAARAYDRAAYAMRGQIAVLNFPAEARNYVRGGSSSSRQQQQGGGGGGGSGGGAGQQVIELECLDDQVLQEMLKGGDGKK

SEQ ID NO: 2131 - DNA, 760 bp, Capsicum annuum
  G3795,family:WRKY
aaataatcccagtgcaaacatgcttgatgggagttttagatcattggactcacctgacagtgatgatttctcaaaccacctaattaactttgagctttctgatattctcgaaatagataattggcccattcaacaagatccgacactcataccccagtactcaaattatgcagcaaaccaagtggttaacaccagcagttaccaggaagaacctagcaacaacattggaagcagcagcagcaagaggaaagaagtaaaggacaaggttgctttcagaacgctatcacagattgaaatactagacgatggctataagtggagaaagtatggaaagaagatggtgaaaaatagtcccaacccgaggaattactataggtgctccgtagaaggttgtccagtgaagaagagagttgaacgagacaaagaggactctcggtatgtgataaccacctacgagggtgtccacaaccatcaaggtctatccccattctgattcctgtaacagagctcgagtttgaaagttactatgactcttgcacggtagctagctaaatcagggttctactgccagtaaattgaatcctgacagcttggcgagttcataaccaaacattgtggggtggtcagacggaggcatcgatctgtaacttaaaagtaatcgttagaacatttcgtgcccttcagttggcatgtagtcttatcctgcttcctacatgatttatatatcctacagcactatcaactaaaaaaaaaaaaaaaa

SEQ ID NO: 2132 - protein, 157 aa, Capsicum annuum
  G3795,WRKY domain coordinates 95-151
MLDGSFRSLDSPDSDDFSNHLINFELSDILEIDNWPIQQDPTLIPQYSNYAANQVVNTSSYQEEPSNNIGSSSSKRKEVKDKVAFRTLSQIEILDDGYKWRKYGKKMVKNSPNPRNYYRCSVEGCPVKKRVERDKEDSRYVITTYEGVHNHQGLSPF

SEQ ID NO: 2133 - DNA, 712 bp, Lactuca sativa
  G3797,family:WRKY
ggcataccaaaatgaattattatgatcatcaaatgtctaaagcctacagttacagatcagtagactcgcctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagttgtttttctaagcttactccatcactagcttattgaaaagaaagttgtagttcggttacttattttcttcaaccgaccaaggttatgaatcgttttagaatataattgtttttaact

SEQ ID NO: 2134 - protein, 180 aa, Lactuca sativa
  G3797,WRKY domain coordinates 118-174
MNYYDHQMSKAYSYRSVDSPDMDYDVPNQQTYEFVESFLSFDDWITEDKASTVPEYQDHTPVYPSATIEDGGLSIGSSSSNSHLHDGSRSRATGFGQAQNGKKEKVAFKTKSQVEILDDGFKWRKYGKKMVKNSPNPRNYYRCSAAGCSVKKRVERDVEDARYVITTYEGIHNHQRPSNY

SEQ ID NO: 2135 - DNA, 1440 bp, Arabidopsis thaliana
  G38,family:AP2
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 2136 - protein, 335 aa, Arabidopsis thaliana
  G38,AP2 domain coordinates 76-143
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 2137 - DNA, 866 bp, Sorghum bicolor
  G3802,family:WRKY
gcacgaggctgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagcttcccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcatccagtacggcggcggcggcggcaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattccgacctgcttgtacatttttacacacttgtgcagtacaagtaataatatttaagctagaagcagtgtactctactttatttacctc

SEQ ID NO: 2138 - protein, 206 aa, Sorghum bicolor
  G3802,WRKY domain coordinates 110-166
MQMAASLGLNPEALFASYSSAYSSSSPFVSDYAASFPAAVDSATAFSAELDDLHHFDYSPAPIFTAVGAGAGGDRNEKMMMWCEGGGDEKRLRSSGRIGFRTRSEVEILDDGFKWRKYGKKAVKNSPNPRNYYRCSSEGCGVKKRVERDRDDPRYVITTYDGVHNHASPGAAAIIQYGGGGGNSGFYSPPHSGSPSAASYSGSFVF

SEQ ID NO: 2139 - DNA, 628 bp, Glycine max
  G3803,family:WRKY
acatatctagctattacctcaatggattactattttggaaaccctaatcctaaaccttatgataaccgtcactctgccgtagtgaacacggaatctccttcctccgagttcatgctatctgattatctcgtgttggaagatgctgtcgataatcaagagtcttggtcacaaagcactgaaactgaatcatcggagaaaggaaactccagcgatgtcagtcatgggtttggtgatgcaaccttcagcaacaccaacatgcatataaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaaggaactactacaagtgttcaggtgaaggatgcaatgtgaagaaaagggtggaaagagacagggatgactcgaactatgttttaacaacgtacgacggtgtccacaatcatgagagcccgtcgactgcctactacagccaaattcccttggtgcattctaaccatgattggccccagctgcacccttctgcaaactcatgatcctcttcaatacagt

SEQ ID NO: 2140 - protein, 196 aa, Glycine max
  G3803,WRKY domain coordinates 111-167
MDYYFGNPNPKPYDNRHSAVVNTESPSSEFMLSDYLVLEDAVDNQESWSQSTETESSEKGNSSDVSHGFGDATFSNTNMHIKCENNGIKRKKEEVSQMITFRTRSQLEVMDDGYKWRKYGKKTVKNNPNPRNYYKCSGEGCNVKKRVERDRDDSNYVLTTYDGVHNHESPSTAYYSQIPLVHSNHDWPQLHPSANS

SEQ ID NO: 2141 - DNA, 823 bp, Zea mays
  misc_feature (9)..(9): n is a, c, g, or t
  misc_feature (802)..(802): n is a, c, g, or t
  G3804,family:WRKY
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 2142 - protein, 205 aa, Zea mays
  G3804,WRKY domain coordinates 108-164
MATSLGLNPEDLFTSYSSSYYSSPPFMSDYAASFTPAGGDSTAFSSELDNLHHFDYSPAPIVTAAGAGAGGGDRNEKMMWCQGGGDERRLRSNGRIGFRTRSQVEILDDGFKWRKYGKKAVKNSPNPRNYYRCSSEGCGVKKRVERDRDDPRYVITTYDGVHNHASPAAAAIIVPYGNGGGNSGFYSPPHSGSPSATSYSGSLVF

SEQ ID NO: 2143 - DNA, 1626 bp, Oryza sativa (japonica cultivar-group)
  G3815,family:SCR
atgtcagctagggcttcaaaccatgcatatatatgttcagatgattctcaaatgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgctgagttcagtggtgaacagtaccatcaaaacgctgttgcatacttacaatagcttctacaggcttgaggagcgagatggtgttctttaccttggatggaagaacagagtattggttgtatcttctgcatggtgttga

SEQ ID NO: 2144 - protein, 541 aa, Oryza sativa (japonica cultivar-group)
  G3815,SCR domain coordinates 250-314,391-464,468-540
MSARASNHAYICSDDSQMPYYNNSVPSGGNGRFYITQNHQDAHYASSDDGSQKIGSSPQAFEAPYCTLESSSANGAHPAHSSASSHSISPISGSPLSHHDSHSDHTYNSPPSASCVTEITDLQIKLRELENAILGPELDIAYDSPESALQPNIMATPENWRQLLGINTGDLKQVIIACGKAVAENDVRLTELLISELGQMVSVSGDPLQRLGAYMLEGLVARLSSSGSKIYKSLKCKEPTSSELMSYMHLLYEICPFFKFGYMSANGAIAEAIKGENFVHIIDFQIAQGSQWMTLIQALAARPGGPPFLRITGIDDSNSAYARGGGLDIVGMRLYKVAQSFGLPFEFNAVPAASHEVYLEHLDIRVGEVIVVNFAYQLHHTPDESVSTENHRDRILRMVKSLSPRLVTLVEQESNTNTRPFFPRYLETLDYYTAMFESIDVALPRDDKRRMSAEQHCVARDIVNLIACEGAERVERHEVFGKWKARLTMAGFRPYPLSSVVNSTIKTLLHTYNSFYRLEERDGVLYLGWKNRVLVVSSAWC

SEQ ID NO: 2145 - DNA, 1872 bp, Triticum aestivum
  G3816,family:SCR
atgaagcgggagtaccaggacgccggagggagcggcggcggcggtggcggcatgggctcgtccgaggacaagatgatggtgtcggcggcggcgggggagggggaggaggtggacgagctgctggcggcgctcgggtacaaggtgcgcgcctccgacatggcggacgtggcgcagaagctggagcagctcgagatggccatggggatgggcggcgtgggcgccggcgccgcccccgacgacagcttcgccacccacctcgccacggacaccgtgcactacaaccccaccgacctgtcgtcttgggtcgagagcatgctgtcggagctcaacgcgccgccgccgcccctcccgcccgccccgcagctcaacgcctccacctcctccaccgtcacgggcagcggcggctacttcgatctcccgccctccgtcgactcctccagcagcatctacgcgctgcggccgatcccctccccggccggcgcgacggcgccggccgacctgtccgccgactccgtgcgggatcccaagcggatgcgcactggcgggagcagcacctcgtcgtcatcctcctcctcgtcgtctctcggtgggggcgccaggagctctgtggtggaggctgccccgccggtcgcggccgcggccaacgcgacgcccgcgctgccggtcgtcgtggtcgacacgcaggaggccgggattcggctggtgcacgcgctgctggcgtgcgcggaggccgtgcagcaggagaacctctccgccgcggaggcgctggtgaagcagatacccttgctggccgcgtcccagggcggcgcgatgcgcaaggtcgccgcctacttcggcgaggccctcgcccgccgcgtcttccgcttccgcccgcagccggacagctccctcctcgacgccgccttcgccgacctcctccacgcgcacttctacgagtcctgcccctacctcaagttcgcgcacttcaccgccaaccaggccatcctggaggcgttcgccggctgccgccgcgtgcacgtcgtcgacttcggcatcaagcaggggatgcagtggcccgcacttctccaggccctcgccctccgtcccggcggccctccctcgttccgcctcaccggcgtcggccccccgcagccggacgagaccgacgccctgcagcaggtgggctggaagctcgcccagttcgcgcacaccatccgcgtcgacttccagtaccgcggcctcgtcgccgccacgctcgcggacctggagccgttcatgctgcagccggagggcgaggaggacccgaacgaggagcccgaggtaatcgccgtcaactcagtcttcgagatgcaccggctgctcgcgcagcccggcgccctggagaaggtcctgggcaccgtgcgcgccgtgcggcccaggatcgtcaccgtggtggagcaggaggcgaatcacaactccggcacattcctggaccgcttcaccgagtctctgcactactactccaccatgttcgattccctcgagggcggcagctccggcggcggcccatccgaagtctcatcgggggctgctgctgctcctgccgccgccggcacggaccaggtcatgtccgaggtgtacctcggccggcagatctgcaacgtggtggcctgcgagggggcggagcgcacagagcgccacgagacgctgggccagtggcggaaccggctgggcaacgccgggttcgagaccgtccacctgggctccaatgcctacaagcaggcgagcacgctgctggcgctcttcgccggcggcgacggctacaaggtggaggagaaggaaggctgcctgacgctggggtggcacacgcgcccgctgatcgccacctcggcatggcgcctggccgggccgtga

SEQ ID NO: 2146 - protein, 623 aa, Triticum aestivum
  G3816,SCR domain coordinates 307-373,446-540,544-618
MKREYQDAGGSGGGGGGMGSSEDKMMVSAAAGEGEEVDELLAALGYKVRASDMADVAQKLEQLEMAMGMGGVGAGAAPDDSFATHLATDTVHYNPTDLSSWVESMLSELNAPPPPLPPAPQLNASTSSTVTGSGGYFDLPPSVDSSSSIYALRPIPSPAGATAPADLSADSVRDPKRMRTGGSSTSSSSSSSSSLGGGARSSVVEAAPPVAAAANATPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGTFLDRFTESLHYYSTMFDSLEGGSSGGGPSEVSSGAAAAPAAAGTDQVMSEVYLGRQICNVVACEGAERTERHETLGQWRNRLGNAGFETVHLGSNAYKQASTLLALFAGGDGYKVEEKEGCLTLGWHTRPLIATSAWRLAGP

SEQ ID NO: 2147 - DNA, 2500 bp, Oryza sativa (japonica cultivar-group)
  G3817,family:SCR
actagttgcttgcctcttcccacctcacctcgcattgcaatctcgcatcgcctcttccttctctttttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagttaaaaa

SEQ ID NO: 2148 - protein, 625 aa, Oryza sativa (japonica cultivar-group)
  G3817,SCR domain coordinates 313-379,487-542,546-620
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 2149 - DNA, 2033 bp, Glycine max
  G3818,family:SCR
tgcctgatcgctacttaacacaaactagcaagtagcatcacgcatcatggtcatacattatacaaggcaacttctccgttaatttcctcacacatccctttctccctctttctctttctctttctctttctctccttccttttcatcactcacttttcactcccaagtcccaaccacaacccctcctctcctctcctcgatcagtgccataaatcaattctttctttctatctatctctgtccacaattctctttatgtcaacaaacctaaaactaaaacctgcttgagagagtagggaattaattaattaattttctttcatttcatcttttaagttgatctgtgaaaatggcttcatcttcctccaacggcagttccagcggaagcaagagttgggacatcgacggcgacctcgccggtttcggctacaaagtccgttcatcggagctgcaacacgtggcagaaaacatggagcgtttagagaacgtgatggacattgtgaactcatcaaccaacaataacatatctcagctggcctccgatacagtcttctacaacccctccgacataggttcctgggtcgacacgcttctctccgagttcgaccaaacggcgtcgttgccctacgatttctcggattttctcgatctcgacacggatcagaatcaaaaccacaaaccaacgctggtaacaatggaagaagactcagggataagactcgtccacacgctgatgacctgtgcggattccgtgcaacgtggtgacctcgcattcgcgggctccctcatcgagaacatgcaggggctgttggctcacgtgaacaccaacatcggaatcggtaaagtcgctggatatttcatcgatgccttgcgccgtcgcatcttagggcaaggcgtgtttcaaacgttgtcgtcgtcctcgtatccgtacgaggacaacgtactctaccaccactactacgaggcctgcccttacttgaagttcgcgcacttcacggcgaatcaggctattttagaagctttcaacggtcatgattgtgtccacgtgattgacttcaatctcatgcaggggctccagtggcccgcgctgattcaggccctggcgcttcggcccggtgggcctccgctgttgaggctcacgggaattgggcctccctcgtctgacaaccgcgacacgctccgcgaaatcgggctcaggctcgctgagctggcgcggtcggttaatgttagatttgcatttcgtggcgtggcggcgtggcggctcgaagacgtgaagccgtggatgctgcaggtgaatccgaacgaagccgtggcggttaactccatcatgcagttgcatcggcttcttgcttcggactccgatccaataggttcgggcatcgaaaccgtgctgggttggatccgaagcttgaacccgaagattatttccgttgtagaacaggaagcgaaccacaaccaggaccggttcttggagcggttcacggaagcgttgcattactactcgaccgtttttgactcgctggaggcgtgtccggtcgaaccggacaaggcacttgcggagatgtacctgcaaagggagatatgcaacgtggtgagcagcgagggaccggcgcgagtcgagaggcacgagccgctggctaagtggagggagcggctcgagaaagccggcttcaagccgctgcatttggggtcaaacgcgtacaagcaagccagcatgttgctgactcttttctctgctgaagggtactccgtggaagagaatcaaggatgcttgactttggggtggcatagccgccctctcattgcggcttcggcttggcaagctgcgccgatgcaggacagggaaacgctgcgtttcgagcaatgagtttcaagaaacggaaaaattgtttaattatagtagtaactagtaaacaagagtgatgtataatgtaaatttttctctctctaaaaaaaaaaaaaaaaaggcggcccctttattttctctttctttttttttcttttctgtttttttttaaatggtcatttttgcg

SEQ ID NO: 2150 - protein, 505 aa, Glycine max
  G3818,SCR domain coordinates 200-266,348-413,417-490
MASSSSNGSSSGSKSWDIDGDLAGFGYKVRSSELQHVAENMERLENVMDIVNSSTNNNISQLASDTVFYNPSDIGSWVDTLLSEFDQTASLPYDFSDFLDLDTDQNQNHKPTLVTMEEDSGIRLVHTLMTCADSVQRGDLAFAGSLIENMQGLLAHVNTNIGIGKVAGYFIDALRRRILGQGVFQTLSSSSYPYEDNVLYHHYYEACPYLKFAHFTANQAILEAFNGHDCVHVIDFNLMQGLQWPALIQALALRPGGPPLLRLTGIGPPSSDNRDTLREIGLRLAELARSVNVRFAFRGVAAWRLEDVKPWMLQVNPNEAVAVNSIMQLHRLLASDSDPIGSGIETVLGWIRSLNPKIISVVEQEANHNQDRFLERFTEALHYYSTVFDSLEACPVEPDKALAEMYLQREICNVVSSEGPARVERHEPLAKWRERLEKAGFKPLHLGSNAYKQASMLLTLFSAEGYSVEENQGCLTLGWHSRPLIAASAWQAAPMQDRETLRFEQ

SEQ ID NO: 2151 - DNA, 1599 bp, Oryza sativa (japonica cultivar-group)
  G3819,family:SCR
atgggcatgtcccctgagccatgcaactccatctcagactgttcccagcagcagagccatcatctgactctgacacagcaacaagattcaacgattatttgtactaatcaagaacttgattattactaccgattctacgacgtggacgaagcggcgtttgatggcaacgaggtagagctcgtctccaggttctccaaggtcaccaggatggaccacatgatcagctcgccgtatcagccgacgtggtcgccggcacaggccgccgtcgacgtcgtcgggtcgtcggagacgtcgcgcgtcaggaagaagaggttctgggacgttcttgagagttgcaagcagaaggtcgaggccatggaggctatggacacaccggcgacggcgacgttccgggtcggtgccggtgatggcggcggcggcggcgggggtggcgcaggaggaggaggaggaggagctgacgggatgcgtctcgtgcagctgctggtcgcctgcgccgaggcggtggcgtgccgcgaccgcgcgcaggcggcggcgctgctgcgcgagctgcaggccggcgcgcccgtgcacggcacggcgttccagcgcgtcgcgtcgtgcttcgtgcaggggctcgcggaccggctgccgctggcgcacccgccggcgctggggccagcgagcatggcgttctgcatcccgccgtcgtcgtgcgcggggcgcgacggcgcgcgcggcgaggcgctcgcgctggcctacgagctgtgcccgtacctgcggttcgcgcacttcgtggcgaacgcgtgcatgctggaagccttcgagggagagagcaacgtccacgtggtcgatctcggcatgacgctgggcctcgaccgtggccaccagtggcgcggcctcctcgacggcctcgccgcccgcgccagcggcaagccggcgcgcgtgcgggtcaccggcgtcggcgcgcgcatggacaccatgagagcgatcgggcgggagctcgaggcgtacgcggaggggttagggatgtacctcgagttcagaggcatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgggccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgccgaccagtggcgccgccgcatgagccgcgcggggttccagtcggtgccgatcaagatggcggccaaggcgcgggagtggctggacgagaacgccggcggcggcgggtacacggtggcggaggagaaaggctgcctcgtgctcggctggaaggggaagccggtcatcgccgcctcgtgctggaaatgctag

SEQ ID NO: 2152 - protein, 532 aa, Oryza sativa (japonica cultivar-group)
  G3819,SCR domain coordinates 242-313,373-454,458-530
MGMSPEPCNSISDCSQQQSHHLTLTQQQDSTIICTNQELDYYYRFYDVDEAAFDGNEVELVSRFSKVTRMDHMISSPYQPTWSPAQAAVDVVGSSETSRVRKKRFWDVLESCKQKVEAMEAMDTPATATFRVGAGDGGGGGGGGAGGGGGGADGMRLVQLLVACAEAVACRDRAQAAALLRELQAGAPVHGTAFQRVASCFVQGLADRLPLAHPPALGPASMAFCIPPSSCAGRDGARGEALALAYELCPYLRFAHFVANACMLEAFEGESNVHVVDLGMTLGLDRGHQWRGLLDGLAARASGKPARVRVTGVGARMDTMRAIGRELEAYAEGLGMYLEFRGINRGLESLHIDDLGVDADEAVAINSVLELHSVVKESRGALNSVLQTIRKLSPRAFVLVEQDAGHNGPFFLGRFMEALHYYAALFDALDAALPRYDARRARVEQFHFGAEIRNVVGCEGAARVERHERADQWRRRMSRAGFQSVPIKMAAKAREWLDENAGGGGYTVAEEKGCLVLGWKGKPVIAASCWKC

SEQ ID NO: 2153 - DNA, 3277 bp, Pisum sativum
  G3821,family:SCR
cagaaacatccaaaaggcaaaaggcatagagaaccgtgttgtattgtgttatagtctatagagagagaatcctttctcattcaattcaattactcagtcctatgagagaacagaatcctttagctactgtctcaatcttcacaacgttatctccttgtaactttggaaccaacaacaacattaacacatggttttttccctcttaaaccaacacaacactactactatgtctatgtctatgtccattctccacctttattatttcattctctttacttactagtagaactcaatattcatcttcttcctcttcttctcattatggctgcttgtgctttgttcaatggtgttggaggaggaaacactactcctgatgaaaccaacaacaatagtacctctaactcaagcaacatcagcactgaagattttcacaacatgccacaacaacaacctcatcattctgaaagaaaattactcagaaaaagaatggcttctgaaatggaacttcaacttcacaacaacaacaacaacaacgattatcataggttttctcgtcgaaccaacaacacttcctcgttgaattgctctttacctgcaaccacacaaaaaggtgtcactactacaacaacaacaacattagcctcatcaggtaataataataacaataataataataataataactatcattatcataacaataataataatagtattattaacaataataataataacgttgctttgtcacgagataacgttgctattcaaaatttccctactgtgaccgtcacaaccaactactccactatgttgctaccttcttcttgttcttccaacctcaacaattcctctacctctgctgcaaactacactcattaccaacaaccacttgtagaagaacaaaacactcttcctgaaatctgtggattctctggtttacctctttttccatctcaaaataaccaaacaaaccgaaccaacaacaacagcagcaacaacagaaacaacactaacactgttgttgatgttgttagttcttctccttcaatggaagaaacctcggctacaacaaactggattgacggtattttgaaggatcttattcatacttcaaacagtgtttccattcctcaactcatcaacaatgttagagagataatatatccttgcaatccaaaccttgctcttgttcttgaacacaggctccgtcttctcacagaaccaaacacttgtgttccagagagaaaaagaaacagcactgaacaaagtggtgttaatgttaatggtaatgttttagctgcttcaaatgttaataactcttcagtgaaactcatgaaccgtgttgatgatgttgttccaacaagtttacatttttctgactcttcaactcttctgaatcaaaaccaaaatcaaaacatgtttcccaattggggtgctactcaaatcaacaacaacaacaacccttcagtttcgttggttactttaccttcacaaccactatccactcaacaagatcaacaacatcaacttcaacaacatccagaagatcttgctcctgcaacaacaactactactacttctgctgagttggcactagcaaggaagaagaaagaggagattaaagaacagaagaagaaagatgaagaaggtttgcaccttctaacacttcttctccaatgcgcagaagctgtatcagcagagaatctagaacaagcaaacaagatgttactcgagatttcgcagctctcgactccattcgggacttcggcacaaagagtagcagcttatttctcggaagccatttcagctagactagtgagttcatgtttaggaatctatgcaacacttccagtttcatcacacacaccacacaatcaaaaagttgcttcagcttttcaagtcttcaatggaattagtccatttgtgaaattctctcacttcactgctaaccaagctatacaagaagcatttgaaagagaagaacgagttcacatcatagatcttgacataatgcaaggcttacaatggcctggtctttttcatatccttgcttcaagaccaggtggtccaccttatgtgagactcactggattaggtacttccatggaaacacttgaagctactggtaaacgtttgtctgactttgctaataaacttggtcttccttttgagttctttcctgttgctgagaaagttggaaacattgatgttgagaagctgaatgtgagtaaatcagaagctgttgctgttcattggttacaacattctttatatgatgtaactggatcagatacaaacactttgtggctcttgcaaaggttggcacctaaagtggtaacagtagtggaacaagacctgagcaatgcaggttcattcttaggaaggtttgtggaagcaatacattactactcagcactatttgattctcttggttcaagctatggtgaagagagtgaagagagacatgtggtggagcagcagctattatcaagagagattcgtaatgtacttgcggtcggagggccatcgagaagtggcgagataaagtttcataattggagagaaaaacttcaacagtgtggttttagaggtgtctctttggctggtaatgctgctactcaagctagtcttcttcttggtatgttcccttctgaagggtatactttggttgaagataatggtattcttaaacttggttggaaagatctttgtttacttactgcttctgcttggagacctccttatcataccaacactatcattcctcatcataactaataatctcgactaaatatgatagtcgagattggtaactccttgactgcagataatatattttcatatctaacttttgtttagttatgaaagtgaattatctgctgtcacttgtcattagttatgataatcttaattgttgatgtagatcggaaggttcagattgatttatccaagttgttatgtgagtggcctgatgtggacctggtgagttggagtagctcggttgttggtgttttgattttttatattctaatgctatgtagtatctctatgttgttgctctaattaaaatgtaagagatattgttaggtgtttgaagagcatgtgatttttcttgctaccaaatgtgtacggcttcagtgatgacacaaaagtacttaataatagaagagagggatctgaaaatggctgaagtggtacacatttaatgtgatatattttgttttattaggagaattcatgaggatgttgctgtgatatttcttaaaaaaaaaaa

SEQ ID NO: 2154 - protein, 819 aa, Pisum sativum
  G3821,SCR domain coordinates 526-592,655-729,733-805
MAACALFNGVGGGNTTPDETNNNSTSNSSNISTEDFHNMPQQQPHHSERKLLRKRMASEMELQLHNNNNNNDYHRFSRRTNNTSSLNCSLPATTQKGVTTTTTTTLASSGNNNNNNNNNNNYHYHNNNNNSIINNNNNNVALSRDNVAIQNFPTVTVTTNYSTMLLPSSCSSNLNNSSTSAANYTHYQQPLVEEQNTLPEICGFSGLPLFPSQNNQTNRTNNNSSNNRNNTNTVVDVVSSSPSMEETSATTNWIDGILKDLIHTSNSVSIPQLINNVREIIYPCNPNLALVLEHRLRLLTEPNTCVPERKRNSTEQSGVNVNGNVLAASNVNNSSVKLMNRVDDVVPTSLHFSDSSTLLNQNQNQNMFPNWGATQINNNNNPSVSLVTLPSQPLSTQQDQQHQLQQHPEDLAPATTTTTTSAELALARKKKEEIKEQKKKDEEGLHLLTLLLQCAEAVSAENLEQANKMLLEISQLSTPFGTSAQRVAAYFSEAISARLVSSCLGIYATLPVSSHTPHNQKVASAFQVFNGISPFVKFSHFTANQAIQEAFEREERVHIIDLDIMQGLQWPGLFHILASRPGGPPYVRLTGLGTSMETLEATGKRLSDFANKLGLPFEFFPVAEKVGNIDVEKLNVSKSEAVAVHWLQHSLYDVTGSDTNTLWLLQRLAPKVVTVVEQDLSNAGSFLGRFVEAIHYYSALFDSLGSSYGEESEERHVVEQQLLSREIRNVLAVGGPSRSGEIKFHNWREKLQQCGFRGVSLAGNAATQASLLLGMFPSEGYTLVEDNGILKLGWKDLCLLTASAWRPPYHTNTIIPHHN

SEQ ID NO: 2155 - DNA, 2253 bp, Zea mays
  G3822,family:SCR
atgccaccgccaccgcctccgcctcctctcactccttattgccgccgctgccctcccccacacctccctccgcctcctccttcttccccaaaccacttcctcctccactacctccatcagctagaccaccaagaagccgccgccgccgccatggtccgcaagcgccccgcgtccgacatggacctcccgccgccgcgccgccacgtcacgggcgacctctccgacgtcacggcggccgctgccgccggtgttggtggtagtggcgcgccgtcctccgccagcgcgcagctgcccgcgctgcccacccagctccaccagctgccccccgcgttccagcaccacgcgccggaggtggacgtgcccgcgcacccggccccggccgcccacgcgcaggcgggcggcgaggcaaccgcgtccacgaccgcgtgggtggacggcatcatccgcgacatcatcgggagcagcggcggcgccgcggtctccatcacgcagctcatccacaacgtccgcgagatcatccacccctgcaaccccggcctcgcgtcgctcctggagctccgcctccgctccctcctcgcagccgacccggccccactgccgccgccgccgcagccgcagcagcatgctctcctgcacggcgctccggccgccgctcccgcggggctgacgctccctcccccgccaccgcttccggacaagcgccgccacgagcatccaccgccgtgccagcagcaacagcaggaggaaccgcatccggcgccgcagtcgcccaaggccccgaccgcggaagagaccgcagcggcggccgccgccgcacaagcagcagctgctgcggccgccaaggagcggaaggaggagcagcggcggaagcagcgcgacgaggagggcctccacctgctgacgctgctgctgcagtgcgccgaggccgtgaacgcggacaacctggacgacgcgcaccagacgctgctggagatcgcggagctagcgacgccgttcggcacctcgacgcagcgcgtggccgcctacttcgcggaggccatgtcggcgcggctcgtcagctcctgcctgggcctgtacgcgccgctgccgccgggctcccccgccgcggcgcgcctccacggccgcgtcgccgccgcgttccaggtgttcaacggcatcagccccttcgtcaagttctcgcacttcaccgccaaccaggccatccaggaggcgttcgagcgggaggagcgcgtgcacatcatcgacctcgacatcatgcaggggctgcagtggccggggctcttccacatccttgcctcccgccccgggggcccgcccagggtgaggctcaccggcctcggggcgtccatggaggcgctcgaggccacggggaagcgcctctccgatttcgccgacacgctcggcctgcccttcgagttctgcgccgtcgccgagaaggccggcaatgttgacccggagaagctaggggtcacgaggcgggaggccgtcgccgtccactggctgcaccactcgctctacgacgtcactggctccgactccaacacgctctggctcatccaaaggctggcccccaaggtggtgacaatggtggagcaggacctgagccactcgggctccttcctggcgcgcttcgtggaggccatccactactactcggcgctgttcgactcgctggacgcgagctacggcgaggacagccccgagcggcacgtcgtggagcagcagctgctgtcgcgggagatccgcaacgtgctggccgtgggcgggccggcccgcaccggcgacgtcaagttcggcagctggcgcgagaagctggcgcagtccgggttccgcgccgcctcgctcgccggcagcgccgcggcgcaggcgtccctgctgctcggcatgttcccctccgacgggtacacgctggtggaggagaacggcgcgctgaagctcgggtggaaggacctctgcctgctcaccgcgtcggcctggcgccccatccaggtgccgccgtgccgttgatgagacctctgcctgctcctgcttgcgttgagaggccgccactccacttgttttgcatctgtagctgctcggtttggtcatcagctgggagataagaaaagcggaaacgtactaattgctctggagtagatccatccattcacagtgatagttactgatgtactaagctttaattagttcaatgctagatcgttcttgttcaggtgtcgatcgcgtatccttgtccttggtctccttttcattttg

SEQ ID NO: 2156 - protein, 668 aa, Zea mays
  G3822,SCR domain coordinates 380-446,495-583,587-659
MPPPPPPPPLTPYCRRCPPPHLPPPPPSSPNHFLLHYLHQLDHQEAAAAAMVRKRPASDMDLPPPRRHVTGDLSDVTAAAAAGVGGSGAPSSASAQLPALPTQLHQLPPAFQHHAPEVDVPAHPAPAAHAQAGGEATASTTAWVDGIIRDIIGSSGGAAVSITQLIHNVREIIHPCNPGLASLLELRLRSLLAADPAPLPPPPQPQQHALLHGAPAAAPAGLTLPPPPPLPDKRRHEHPPPCQQQQQEEPHPAPQSPKAPTAEETAAAAAAAQAAAAAAAKERKEEQRRKQRDEEGLHLLTLLLQCAEAVNADNLDDAHQTLLEIAELATPFGTSTQRVAAYFAEAMSARLVSSCLGLYAPLPPGSPAAARLHGRVAAAFQVFNGISPFVKFSHFTANQAIQEAFEREERVHIIDLDIMQGLQWPGLFHILASRPGGPPRVRLTGLGASMEALEATGKRLSDFADTLGLPFEFCAVAEKAGNVDPEKLGVTRREAVAVHWLHHSLYDVTGSDSNTLWLIQRLAPKVVTMVEQDLSHSGSFLARFVEAIHYYSALFDSLDASYGEDSPERHVVEQQLLSREIRNVLAVGGPARTGDVKFGSWREKLAQSGFRAASLAGSAAAQASLLLGMFPSDGYTLVEENGALKLGWKDLCLLTASAWRPIQVPPCR

SEQ ID NO: 2157 - DNA, 2084 bp, Solanum lycopersicum
  G3825,family:SCR
atttttctccaaattttatcaatctacaagttagattcctccttctgcagattatatcaggtggatttcggtgaagcagatattaagtgttagtgagaaagagtttgcgcatagagcagctaatgacagccgtatagtatggactcgcaccatttggttgcttatggtgtgaccggtagtgatttgtcgtattcttcatgccctactgttagtcctctagagaatagaccatttggtacatcgaaatttgattcaggaaattcgccacttgtgaactattttaactctgagaccttcaacacagtaagtgattaccaggagcagcccagctgtacagagaatctttcaggtgctagttcttcaagtggttcctcactggattataaccaatatttccatcgaccaagcccctcggaagatcatcttccagaagctccttacagtcggaacatgaaacatactctgctgcagttggagtctgctttaatggggccagacaaagaggcaatgaaatccagcccttatcttggtgaaaatatgggggcacaaacatcaggtcagaggtataaagcgtggaacaaggaagcccaagttgtgcgtcatcaacaatcagtagtttcaatccttaatggaattcaaagtgataagcgagacaatgtaatggaggacttgcccttgcagggtgttccgtctagcaatctgaagcagctgcttatagcatgcgccagagctcttgctgaaaacaagctagatgattttgaaatactggttgctaaggcaaggagtgttgtgtccgttactggagatcccatccagcgtcttggtgcttacattgtagaaggcctcgtagcaagaaaggagttatctggaactaccatatacaggagtttaaagtgtaaggagccggctggtaaggacttgttctcctacatgtatatcctctatgaaatatgtccttacctaaagttcggctacatggctgcaaatggtgccatagtagaagcatgcagaaatgaagatcgcatccacattatagacttccaaattgcacaggggacccaatggatgactctcttacaagctcttgcagcacgacccggtggtgccccctacgtacgtattacaggaattgatgatccagtttcacagtacgctcggggagatggattggctgcagttgccagacggctatcagcaatttctgaggaattcaacattgctgttgagtttcatgcagtgccagtttttgctccggaaatcacttgggatatgcttgatgtaaggcctggtgaggctctggctgtaaactttcctttgcaacttcaccacacccctgatgagagcgttgacgtgaataaccctagagatggtctcattaggatgataaagtcgcttagccccaagatagtcactttggtggagcaagaatcaaacacgaacacagctccatttctccctaggtttgtagaagctctagattactaccatgcaatgtttgagtccatagatgtgaccctactaagggacatgaaggagcggatcaatgtggaacagcactgtttggctagggatatagtgaatgtcatagcatgtgagggcaaggaaagagtagaacgtcacgagctattggggaagtggaaatccaggttcatgatggcaggttttcagcaatatcctttgagctcttatgtgaattcagtgattaaggacctcatgaagcgttactcggagcattatacactggtggagaaagacggagctatgctgttggggtggaaggagcggaatctagtctctgcgtctgcttggttttaacgagttactgttcattatgtggaaacagatggttagccttcttttttattacttaaccagacaataggattgatcaagtaattatactcatgttatgtagtttcaattttttgaaattttagttgtttatttttcaagttatcgtttgatattatttgttaaaacttataaacaattatatttcgtccttgatgatttgttgggccactttggggattttaaaaaaaaaaaaaaaaaaaaaaaaaaaaaaaaaaaaaaaaaaaaaaaaa

SEQ ID NO: 2158 - protein, 558 aa, Solanum lycopersicum
  G3825,SCR domain coordinates 265-331,441-481,485-557
MDSHHLVAYGVTGSDLSYSSCPTVSPLENRPFGTSKFDSGNSPLVNYFNSETFNTVSDYQEQPSCTENLSGASSSSGSSLDYNQYFHRPSPSEDHLPEAPYSRNMKHTLLQLESALMGPDKEAMKSSPYLGENMGAQTSGQRYKAWNKEAQVVRHQQSVVSILNGIQSDKRDNVMEDLPLQGVPSSNLKQLLIACARALAENKLDDFEILVAKARSVVSVTGDPIQRLGAYIVEGLVARKELSGTTIYRSLKCKEPAGKDLFSYMYILYEICPYLKFGYMAANGAIVEACRNEDRIHIIDFQIAQGTQWMTLLQALAARPGGAPYVRITGIDDPVSQYARGDGLAAVARRLSAISEEFNIAVEFHAVPVFAPEITWDMLDVRPGEALAVNFPLQLHHTPDESVDVNNPRDGLIRMIKSLSPKIVTLVEQESNTNTAPFLPRFVEALDYYHAMFESIDVTLLRDMKERINVEQHCLARDIVNVIACEGKERVERHELLGKWKSRFMMAGFQQYPLSSYVNSVIKDLMKRYSEHYTLVEKDGAMLLGWKERNLVSASAWF

SEQ ID NO: 2159 - DNA, 1582 bp, Zea mays
  G3839,family:CAAT
ctcgaggccggccggggacacccttggtcccaacttacaaagcacagagaagacctaccccgccccggcacacaaggtagcaacatgaataatccccaaaaccctaaagccagtgctccttgcaccttgccatcggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcaccggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcttagctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaaaaaaaaagaaaaaaagaaaaaaaaaaaaaaaaaagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataaagggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctgg

SEQ ID NO: 2160 - protein, 262 aa, Zea mays
  G3839,CAAT domain coordinates 48-137
MNNPQNPKASAPCTLPSELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 2161 - DNA, 2940 bp, Arabidopsis thaliana
  G384,family:HB
gttttttcttctgaagagtgatatatattctacctttctctggttaaagaaactccctgaatccaccggttatgtcttgaccggctttaagcctataaactgatgccctaagacacctttttaggtttctcaataattctccgcatctatcttttcttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggaggtttagggagtttatgataatgtttgtgttcttttggtttttaaagtcttttgagattctccaaaggaagtcaagaacgctcctttttgcgtttaatctcatttccgcgtttgttagcggacgggccaaagaaagaggcttgagaaagaaaaggtaaagaggttcgggtattgacttctgctggaaccaaaaaaaaaggaatcgggtttgttgtgtttcggcggtttagcattttgcgttttctttgttattatttatcattgactagtgaacagtttagcgttctgcttttcgcgtctactgtgaaactccttgttattaagccactctagtggtactgtcattatatattatgaatctatgaaactgtgtttattagtttgtttctttaatccaaacttgagattctcttct

SEQ ID NO: 2162 - protein, 718 aa, Arabidopsis thaliana
  G384,HB domain coordinates 14-77
MENPLEEELQDPNQRPNKKKRYHRHTQRQIQELESFFKECPHPDDKQRKELSRELSLEPLQVKFWFQNKRTQMKAQHERHENQILKSENDKLRAENNRYKDALSNATCPNCGGPAAIGEMSFDEQHLRIENARLREEIDRISAIAAKYVGKPLMANSSSFPQLSSSHHIPSRSLDLEVGNFGNNNNSHTGFVGEMFGSSDILRSVSIPSEADKPMIVELAVAAMEELVRMAQTGDPLWVSSDNSVEILNEEEYFRTFPRGIGPKPIGLRSEASRESTVVIMNHINLIEILMDVNQWSSVFCGIVSRALTLEVLSTGVRGNYNGALQVMTAEFQVPSPLVPTRENYFVRYCKQHSDGIWAVVDVSLDSLRPSPITRSRRRPSGCLIQELQNGYSKVTWVEHIEVDDRSVHNMYKPLVNTGLAFGAKRWVATLDRQCERLASSMASNIPACDLSVITSPEGRKSMLKLAERMVMSFCTGVGASTADAWTTLSTTGSDDVRVMTRKSMDDPGRPPGIVLSAATSFWIPVAPKRVFDFLRDENSRSEWDILSNGGLVQEMAHIANGRDPGNSVSLLRVNSGNSGQSNMLILQESCTDASGSYVIYAPVDIIAMNVVLSGGDPDYVALLPSGFAILPDGSARGGGGSANASAGAGVEGGGEGNNLEVVTTTGSCGGSLLTVAFQILVDSVPTAKLSLGSVATVNSLIKCTVERIKAALACDGA

SEQ ID NO: 2163 - DNA, 705 bp, Solanum lycopersicum
  G3841,family:AP2
atggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcatttaa

SEQ ID NO: 2164 - protein, 234 aa, Solanum lycopersicum
  G3841,AP2 domain coordinates 102-166
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 2165 - DNA, 705 bp, Solanum lycopersicum
  G3843,family:AP2
atgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtgaggccatgggggaaattcgcggcggaaattagagatccggcgaaaaatggagcacgagtttggctcggtacatatgagacggcggaggatgcggcgttggcttacgacaaggcggcttttcgcatgcggggatcacgtgcattgctgaattttccgttgaggattaattccggtgaaccggatcctgttagagttggatcgaagagatcgtcaatgtcgccggagcattgttcatcggcgtcgtcgacgaagaggaggaagaaggttgctcgtggaacaaagcaataa

SEQ ID NO: 2166 - protein, 234 aa, Solanum lycopersicum
  G3843,AP2 domain coordinates 130-194
MYSNCELENDFSVLESIRRYLLEDWEAPLTSSENSTSSEFSRSNSIESNMFSNSFDYTPEIFQNDILNEGFGFGFEFETSDFIIPKLESQMSIESPEMWNLPEFVAPLETAAEVKVETPVEMTTTTTKPKAKHYRGVRVRPWGKFAAEIRDPAKNGARVWLGTYETAEDAALAYDKAAFRMRGSRALLNFPLRINSGEPDPVRVGSKRSSMSPEHCSSASSTKRRKKVARGTKQ

SEQ ID NO: 2167 - DNA, 1231 bp, Medicago truncatula
  G3844,family:AP2
ctctctaaaaaacatcacaaaacgaaaatttcattccttccacactctccaatctccatagcaaattacaacacaaaaactttaccaaaggccacaacatgtacggaaatagtaattttgattccgatcttgcccttttagactctattcgccgccacttgttaggagaatccgaatttatattcggtgctccaacaaatgtttcgggtaatacccgagttttctctcggagctccagtttcagcagcttatacccatgtttaagtgacaattggggtgaactaccactcaaagaagatgattctgaagatatggtactttacggcgtcctccgcgatgccgtaaatgttgggtgggtcccgtctctcgaagtcgggtcacccgaaagtgtctcatcggtttttccgttagaaatgacggtgaaaccggagccggatgttatgccggtggagaatgtcctcccggtagcttcaacagcggagcaagtggttcctgaggggccaaaagctgctccggtgaaaggaaaacactaccgcggtgtgagacaacggccgtgggggaaatttgcggcggagattcgtgatccggcgaagaacggagctagagtttggcttggaacatttgaaaccgctgaggatgcggctttggcttatgatagagctgcgtataggatgagagggtcaagagctttgttgaattttccacttcgggttaactccggtgaacccgacccggttagaatagcttcaaaacgttcttcgccggaacgctcttcgtcatcggaaagtaattctccggcgaagaggaagaaagtaatgacagctcagagtggattaaaaacaggacaagtgggaagtcaagtggcacaacaatgtacacgtggaggacagttattggtttcttaatatacggttctaccgtactaggaacaaaaaatgtttaggttaatgttgtgttgtgtttcttcaatgcaatttgtaattatccgaagacatgtgtgtactgtgtatagcactatgcaactattccttcttttgtgcctacacaattttggaaccaaggaaaaggatgaaaatgtagcaaaatggtgattcatgagggagacaaaaatgcgggagaaaaacaaaaattgaaaaaatgagaaatgaaataatgatgtttaaaggatagtgaatgaagtggggttatgcgatgtaactttgtgaatatagaaattcttatttgtttgatc

SEQ ID NO: 2168 - protein, 268 aa, Medicago truncatula
  G3844,AP2 domain coordinates 141-205
MYGNSNFDSDLALLDSIRRHLLGESEFIFGAPTNVSGNTRVFSRSSSFSSLYPCLSDNWGELPLKEDDSEDMVLYGVLRDAVNVGWVPSLEVGSPESVSSVFPLEMTVKPEPDVMPVENVLPVASTAEQVVPEGPKAAPVKGKHYRGVRQRPWGKFAAEIRDPAKNGARVWLGTFETAEDAALAYDRAAYRMRGSRALLNFPLRVNSGEPDPVRIASKRSSPERSSSSESNSPAKRKKVMTAQSGLKTGQVGSQVAQQCTRGGQLLVS

SEQ ID NO: 2169 - DNA, 841 bp, Nicotiana tabacum
  G3845,family:AP2
acacaagagaactaaaacttaaaagcaaaatgaatcaaccaatttatacagagttgccgccggcgaattttccgggagaatttccggtgtaccgccggaattcaagcttcagtcgtctaatcccatgtttaactgaaacatggggcgacttaccactaaaagtcgacgattctgaagatatggtaatttatactctcttaaaagacgctcttaacgtcggatggtcgccgtttaatttcagcgccggcgaagtaaaatcggagcagagggaggaagaaattgtggtttctccggcggagacgacggccgcgccggcggctgagttacctaggggaaggcattacagaggtgttagacgacggccgtgggggaaatttgcggcggagattagggatccggcgaagaatggagctagggtttggcttggaacatacgaaacagatgaagaagctgcaattgcttatgataaagcggcttatagaatgcgcggttcaaaggctcatttaaattttccacatagaatcggtttaaatgaaccggaaccggttcgagttacggcgaaaagacgagcatcgcctgaaccggctagttcgtcggaaaatagttcacctaaacggagaagaaaggctgttgcaactgagaaatctgaagcagtagaagtggagagtaaatcaaatgttttgcaaactggatgtcaagttgaactattgacacgtcgacatcaattattagtcagttaagtatgaacttaggatattcaattgtggtactcttgagctccaaagttgtacagtttgattctctcatgttaattatatgacaggagggttaattgcaacgt

SEQ ID NO: 2170 - protein, 236 aa, Nicotiana tabacum
  G3845,AP2 domain coordinates 101-165
MNQPIYTELPPANFPGEFPVYRRNSSFSRLIPCLTETWGDLPLKVDDSEDMVIYTLLKDALNVGWSPFNFSAGEVKSEQREEEIVVSPAETTAAPAAELPRGRHYRGVRRRPWGKFAAEIRDPAKNGARVWLGTYETDEEAAIAYDKAAYRMRGSKAHLNFPHRIGLNEPEPVRVTAKRRASPEPASSSENSSPKRRRKAVATEKSEAVEVESKSNVLQTGCQVELLTRRHQLLVS

SEQ ID NO: 2171 - DNA, 947 bp, Nicotiana tabacum
  G3846,family:AP2
acacaacacataaaaaatccaattgcttaaaactcataacaaacaaaatgtatcaaccaatttcgaccgagctacctccgacgagtttcagtagtctcatgccatgtttgacggatacatggggtgacttgccgttaaaagttgatgattccgaagatatggtaatttatgggctcttaagtgacgctttaactgccggatggacgccgtttaatttaacgtccaccgaaataaaagccgagccgagggaggagattgagccagctacgattcctgttccttcagtggctccacctgcggagactacgacggctcaagccgttgttcccaaggggaggcattataggggcgttaggcaaaggccgtgggggaaatttgcggcggaaataagggacccagctaaaaacggcgcacgggtttggctagggacttatgagacggctgaagaagccgcgctcgcttatgataaagcagcttacaggatgcgcggctccaaggctctattgaattttccgcataggatcggcttaaatgagcctgaaccggttagactaaccgctaagagacgatcacctgaaccggctagctcgtcaatatcatcggctttggaaaatggctcgccgaaacggaggagaaaagctgtagcggctaagaaggctgaattagaagtgcaaagccgatcaaatgctatgcaagttgggtgccagatggaacaatttccagttggcgagcagctattagtcagttaagatatgagctaagaactcaattgttaagtttggagtgaatagaaacagcaaactactccactttgctcatagttggaccaaggaggccatttgtattatgtctatggcgtgtaaagtgtcacctttcagtttaaaaacagtatttcttgtcctcactttggattgattaaatggataatactcgctttcgactgggtt

SEQ ID NO: 2172 - protein, 233 aa, Nicotiana tabacum
  G3846,AP2 domain coordinates 95-159
MYQPISTELPPTSFSSLMPCLTDTWGDLPLKVDDSEDMVIYGLLSDALTAGWTPFNLTSTEIKAEPREEIEPATIPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTAKRRSPEPASSSISSALENGSPKRRRKAVAAKKAELEVQSRSNAMQVGCQMEQFPVGEQLLVS

SEQ ID NO: 2173 - DNA, 957 bp, Oryza sativa (japonica cultivar-group)
  G3848,family:AP2
atgacggcgcgaagcatgttgcggaaccacccggaggcgtcggtgctcgacaccatccggcagcacctgctggaggagccgcgcggcggcggcggtggcgaggcggcggaggcgagcttcgggagcctggtggccgacatgtggagcgactcgctgccgttccgcgacgacgacgccgacgacatggtggtgttcggcgcgatgcgggacgcgttctcgtgcgggtggctgcccgacggcgtgttcgcggaggtgaagccggagcccctgctctcgccggactcgtcgtcgtacgacgggtcctcttgctgcttcggcttcgcggacgtgtcggagccggtgacgccgagcgacgcggcgtcgggggcggcagaagcggcggccgcggcggcggcggcgacggcggagcacgggaaggaggaggaggccgcggctgcggtggcgagggggaagcactacaggggggtgaggcagcggccgtggggcaagttcgcggcggagatccgggaccccgccaagaacggcgcgcgcgtgtggctcggcacgttcgacaccgccgaggacgccgccctggcgtacgaccgcgccgcctaccgcatgcgtggctcccgcgcgctcctcaacttcccgctccgcatcggctcggagatcgcagccgccgccgccgccgcagcggcagcggcagccggcgacaagcggccgtcgccggagccggcgacctcggagtcgtccttctcctcctcatcctcctgcaccaccaccaccacctcctcctcaacctcctcctccggctccccgaaacggagaaagagaggcgaggccgcggccgcgtccatgtccatgcccctggtgcccccgccttcccagctgaactggccggtgcaggcatggtaccccgccgccgcaccggtcgagcaggtggcgatcaccccgcgcgtggagcagctcgtcatctaa

SEQ ID NO: 2174 - protein, 318 aa, Oryza sativa (japonica cultivar-group)
  G3848,AP2 domain coordinates 149-213
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2175 - DNA, 819 bp, Solanum lycopersicum
  G3849,family:AP2
ttcacagagacataaacacaaacaccttcactgcaattctcaaaatactgcaaaatgacgaaacaagatgaaggattaacattagaactcatacgacaacatctcctcgaagatttcacaactacagaatcattcatcgacagtctcaattcttgtttttccgatcacatctcctcctccgatgacatctcccctgttttcacttcagtaaaaacagagccatctacatccaattccctctcagattcacccaattcctcatacccaaatgaacccaactccccaatttcccgttacttcaatctccgctccgatttccctgaattcaaaatcgattcagataccatcctcagtccagttttcgacagctccgccggttctaatgaagacaataataagaagaagaattacagaggggtaaggagaaggccatgggggaaatttgcggcggagataagagatccaagtcgaaaaggatcgaggatttggttgggtacttttgatactgatattgatgctgctagagcttatgattgtgcagcgtttaagatgagaggaagaaaagctattctgaattttccgttggatgccggaaaatctggtgctccggcgaatgttggccggaaaaggagaagagagaacaagatggagttggtgtagatgactaatttgtaatttgtgttaaagcatgttaattacttaatcctcttctacatcataattaatagagctttcccccccacatatttattaaagaatatcattccataatgtaaactttgattaacaaatttgaattcctaaaaaaaaaaaaaaaaa

SEQ ID NO: 2176 - protein, 201 aa, Solanum lycopersicum
  G3849,AP2 domain coordinates 115-179
MTKQDEGLTLELIRQHLLEDFTTTESFIDSLNSCFSDHISSSDDISPVFTSVKTEPSTSNSLSDSPNSSYPNEPNSPISRYFNLRSDFPEFKIDSDTILSPVFDSSAGSNEDNNKKKNYRGVRRRPWGKFAAEIRDPSRKGSRIWLGTFDTDIDAARAYDCAAFKMRGRKAILNFPLDAGKSGAPANVGRKRRRENKMELV

SEQ ID NO: 2177 - DNA, 1003 bp, Solanum lycopersicum
  G3851,family:AP2
gaaaacttttctatacatttttcatttctgtatcaatcaatattctttgtttctgctgttttgagtaaacacactaagatgtgtggtggtgcaattcttgctgatatcattcctcctcgtgaccgccgtttgtcatccaccgacctatggccgactgatttctggccaatttccacccaaaatgttcctctcaaccccaaacgagctcgaccctctacaggtggtgagcagatgaagaagaggcaaaggaagaatctttacagagggataagacaacgtccatggggtaaatgggctgctgaaattcgtgacccgagaaaaggggttagggtttggttaggtactttcaacactgctgaagaagctgcaagagcttatgatagagaagctcgtaaaatcaggggtaagaaagctaaagttaatttccccaatgaagatgacgaccattactgctacagtcatccagagccccctcccttgaacattgcttgtgatactactgttacttacaatcaagaatcaaataactgttaccccttttactcaatcgagaacgttgaacctgttatggaatttgcaagttataatggaattgaagatggaggagaggagatggtgaaaaatttgaataacagggttgtagaggaagaggagaaaacagaggatgaagtgcagatactttctgatgagctgatggcttatgagtcattgatgaagttctatgaaataccgtatgttgacgggcaatcagtggcggcgacggtgaatccagcggcggagaccgccgtgggcggtggctcgatggagctttggagttttgatgatgttagtcgtgtacaaccaagttataatgtagtttaattattgttttgtttaaacttttcataattttattttatcgaattaggaagaattgagtttttataatttaatcaattgtgtaaaactatgtttctaattcattaatattatattggatatgttgttatcaaaaaaaaaaaaa

SEQ ID NO: 2178 - protein, 260 aa, Solanum lycopersicum
  G3851,AP2 domain coordinates 57-120
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRVQPSYNVV

SEQ ID NO: 2179 - DNA, 931 bp, Solanum lycopersicum
  G3852,family:AP2
aaaaccttcaaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatggtaaagccgcttttaggatgcgcggtactaaggctctattgaatttcccgcatagaattggtttaaatgagccggagccggttagagtgacggttaagagacgattatctgaatcggctagttcatcggtatcatcagcttcggaaagtggctcgcctaagaggaggagaaagggtgtagcggctaagcaagccgaattagaagttgagagccggggaccaaatgttatgaaagttggttgccaaatgttccagttggcgagcagctattggttagttaaaatatggagctaagaactcaatggctagggcttgtttggctttgaagtggacagaaaatagcaaatcattccactaggtgagaagtggaccaaagaggccatttggactatgtgtatctaacgtgtaaagtgcactttttagtttgtgcttttatgaaaaaaaacacacattttcatatagtggctttt

SEQ ID NO: 2180 - protein, 244 aa, Solanum lycopersicum
  G3852,AP2 domain coordinates 102-167
MYQLPTSTELTFFPAEFPVYCRSSSFSSLMPCLTESWGDLPLKVNDSEDMVIYGFLQDAFSIGWTPSNLTSEEVKLEPREEIEPAMSTSVSPPTVAPAALQPKGRHYRGVRQRPWGKFAAEIRDPAKNGARVWLGTYESAEEAALAYGKAAFRMRGTKALLNFPHRIGLNEPEPVRVTVKRRLSESASSSVSSASESGSPKRRRKGVAAKQAELEVESRGPNVMKVGCQMFQLASSYWLVKIWS

SEQ ID NO: 2181 - DNA, 885 bp, Zea mays
  G3856,family:AP2
atgctgcttaacccggcgtgcgaggcggcagcgccgatggacagcatccggcatcacctcctggacgagccggcggcggcggcgaccgcgagcgcggctccgcggccggtgtactgccgcagcacgagcttcggcagcctagtggcggaccaatggagcgagtcgctcccgttccgccccgacgacgccgacgacatggtcgtcttcggcgcgctccgcgacgccttttcccagggctggctccccgacggctccttcgccgccgtgaagcccgagcccctggcgttcccggactccccctacgagcgcggatcctatccctgccttggtggcttccttctcgcggaggggcctgagacgccgaccgaggcggcgacgacgcccgggagcgaggaggaggccgcggcggcggtgtccagggggaagcactaccgcggggtgaggcagcggccgtggggcaagttcgcggcggagatccgggacccggccaagaacggcgcgcgcgtgtggctgggcacgtacgacagcgccgaggacgccgccgtggcctacgaccgcgccgcgtaccgcatgcgcggctcccgcgcgctcctcaacttcccgctccgcatcggctccgagatcgccgcggcggccgccgccgtcgcggccactgcccctgccgcgggagacaagcgggcgtccccagagccgaccgcgagctccgactcctccccttcggcctcctctgcgacaccgaagcggaggaagagaggcgaggccgctgccgcgaccatggccatggcccttgtgccgcccccgccggcggcgcaggcgcccgtccagctgaccctcccggcccgtccgtggttcgccgccggccccgtccagcagctagtgagctaa

SEQ ID NO: 2182 - protein, 294 aa, Zea mays
  G3856,AP2 domain coordinates 140-204
MLLNPACEAAAPMDSIRHHLLDEPAAAATASAAPRPVYCRSTSFGSLVADQWSESLPFRPDDADDMVVFGALRDAFSQGWLPDGSFAAVKPEPLAFPDSPYERGSYPCLGGFLLAEGPETPTEAATTPGSEEEAAAAVSRGKHYRGVRQRPWGKFAAEIRDPAKNGARVWLGTYDSAEDAAVAYDRAAYRMRGSRALLNFPLRIGSEIAAAAAAVAATAPAAGDKRASPEPTASSDSSPSASSATPKRRKRGEAAAATMAMALVPPPPAAQAPVQLTLPARPWFAAGPVQQLVS

SEQ ID NO: 2183 - DNA, 946 bp, Solanum tuberosum
  G3857,family:AP2
ccaaaaacctcataaatcactagaaaaaactaaaattcaaagcaaaatggatcaacagttgctaccgacgaacttcccggtgtatcgccggaattcaagcttcagtcgtctaatcccctgtttaactgaaacatggggagatttaccactaaaagtcgacgattccgaagatatggtaatttacggtctattaaaggacgctcttagcgtcggatggtcgccgtttagtttcaccaccggcgaagtaaaatcggaaccgagagaggaaattgagtcggcgcctgaatttgtaccttctccggcggagaagacggcagctccggtggctgaaacacccaagggaagacattatagaggcgttagacagcggccgtgggggaaatttgcggcggagattagagatccggcgaagaacggagctagggtttggcttggaacgtatgaaacagctgaagaagctgctattgcttatgataaagctgcttatagaatgagaggatcaaaagcacatttgaatttcccgcaccggatcggtttgaatgaaccggaaccggttcgagttacggcgaaaagacgagcatcgcctgaaccggtaagctcgtcggaaaacggttcaatgaaacggagaagaaaagccgttcggaaatgtgacggagaagtggagagtagatcaagtgttatgcaagttggatgtcaaatcgaacaattgacaggtgtccatcaactattggtcagttaaatagccggcaattttccgaacgcgaaatactttgtgcatattttccccgaacccttaaataaattcgaaatactctatgcatcggactatgatggtggagaagaatcgaaagtccaatgaaaaaaattatcgtgatagggtaatcccgaagttgtaaaaaagtttgattttcattaatattatctttgatctttgataattatttga

SEQ ID NO: 2184 - protein, 230 aa, Solanum tuberosum
  G3857,AP2 domain coordinates 98-162
MDQQLLPTNFPVYRRNSSFSRLIPCLTETWGDLPLKVDDSEDMVIYGLLKDALSVGWSPFSFTTGEVKSEPREEIESAPEFVPSPAEKTAAPVAETPKGRHYRGVRQRPWGKFAAEIRDPAKNGARVWLGTYETAEEAAIAYDKAAYRMRGSKAHLNFPHRIGLNEPEPVRVTAKRRASPEPVSSSENGSMKRRRKAVRKCDGEVESRSSVMQVGCQIEQLTGVHQLLVS

SEQ ID NO: 2185 - DNA, 884 bp, Solanum tuberosum
  G3858,family:AP2
gatcaaaaactcataatgtatcaattacccatttctacagagttacctccgacttttttcccggcagaattcccggtgtattgccggagttcaagtttcagtagtctcatgccatgtttaaccgaatcatggggtgacttgccgttaaaagttaacgattccgaagatatggtaatttatgggcttctacaagacgccttcagtatcggatggacgccgtcaaatttaacgtcagtggaagtgaaacccgagccgagggaggagattgagccagctatgagtacttctgtttctccgccgacagagactgcggcggctccatcggctctgcaacctaaaggaaggcattacaggggcgttagacaaaggccatggggaaaatttgcagcggaaataagagatccagctaaaaacggcgcacgggtttggcttggaacttacgagtcggccgaggaagctgcgctcgcttatgatatagcagcttttaggatgcgcggtactaaggctctattgaatttcccgcatagaatcggtttaaatgagccggagccggttagagtgacggttaagagacgattacctgaaccggctagttcattggtatcatcagcctcggaaagtggctcgctgaagaggaggagaaaaggtgtagcggctaagcaagccgaattagaagttcagagccggggaccaaatgttattcaagttggttgccaaatggaacaatttccagttggcgagcagctattggttagttaaaatatggagctaagaactcaacggcaagggcttgtttcgctttgaagtggacagaaaattgcaattcattccacttggtgagaagtggaccaaagaggccatttggattatgtgtatctaacgtg

SEQ ID NO: 2186 - protein, 247 aa, Solanum tuberosum
  G3858,AP2 domain coordinates 108-172
MYQLPISTELPPTFFPAEFPVYCRSSSFSSLMPCLTESWGDLPLKVNDSEDMVIYGLLQDAFSIGWTPSNLTSVEVKPEPREEIEPAMSTSVSPPTETAAAPSALQPKGRHYRGVRQRPWGKFAAEIRDPAKNGARVWLGTYESAEEAALAYDIAAFRMRGTKALLNFPHRIGLNEPEPVRVTVKRRLPEPASSLVSSASESGSLKRRRKGVAAKQAELEVQSRGPNVIQVGCQMEQFPVGEQLLVS

SEQ ID NO: 2187 - DNA, 1364 bp, Flaveria trinervia
  G3859,family:ZF-HB
aagaaaaccctttgaaaatttcaagattctttgtttggaacatcaaattatggacctaaaacaccccaccacccacaccccacctcattcccactcaacaaacctcttaacctccaccaacggcaaacaccaccaccaccaccaccacccgccgccgcacacggcggtggcatacaaacaatgcctcaagaaccacgccgtcggcatcggttgccacgccgtagacggctgcggtgagttcatgccggctccgacgtacaacccatcacagccatcatccttcaaatgcgccgcctgtggctgccaccgcaacttccaccgccgtgaacccaccatcgccaccaggacccacttcatagacttccaccatcaccacccctcaacctccgcctccttatctccgccgtcgccagcgcctgaactgactaacttcgccgtcggaccgcatctgctgctgtcactcggcacggcggcggagcaaaaccacatggtggcgacgccggagacgccggcggcgatcaagattagtgggaggaaacggtttcggactaaattcagtcaagatcaaaaggaaaagatgttaacttttgcagagaaagtggggtggaagttgcagaggtgtgatgataagatggttgcagatttttgcagtgagattggaatcagaagaagagttttgaaagtttggatgcataataataagaacacttcagccaaaaaagaacaagaaaccaccgccaccgccaccgtcgtcaccaccgccatcaccgtcgccaccggcgtcgactccgccggagtacgtagtgatgatcaagaaaacgggtcgtctttttcatcttaactctgtaaaatctccaaattaaccctttttatggtaaatcgagcaaaccccactaattattaatcatctctctccaaattttcagttattttgaggtgaaatcggttgttaatttatgttcttcctgtaaatatggagcctttaaacaatggttgcatttggtcagagaattaaagaccagatgacccaaattttgaaaataaattcttcaattttagctcatcgggtagatgaatttgatgaagtttgactgattcaaagttgagatggtcaaaataagcaattatgtgttctaaagcattaatggaggttttggtactatttgcagagaagtaatgaatacaacaaacttgcttgtggttgttggcatttagattttggagtagcttttgagattaaccctaatctttgttcttcatatactttaatcattgtttattgtttaatatttaattaagtattctatttgtagaaagttgtttaggttatggcttatcgtttatcttaagtcttgcgattaccc

SEQ ID NO: 2188 - protein, 263 aa, Flaveria trinervia
  G3859,ZF-HB domain coordinates 40-95,162-225
MDLKHPTTHTPPHSHSTNLLTSTNGKHHHHHHHPPPHTAVAYKQCLKNHAVGIGCHAVDGCGEFMPAPTYNPSQPSSFKCAACGCHRNFHRREPTIATRTHFIDFHHHHPSTSASLSPPSPAPELTNFAVGPHLLLSLGTAAEQNHMVATPETPAAIKISGRKRFRTKFSQDQKEKMLTFAEKVGWKLQRCDDKMVADFCSEIGIRRRVLKVWMHNNKNTSAKKEQETTATATVVTTAITVATGVDSAGVRSDDQENGSSFSS

SEQ ID NO: 2189 - DNA, 2409 bp, Arabidopsis thaliana
  G386,family:HB
atgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcgtgccgctttacaatgcgaaagctga

SEQ ID NO: 2190 - protein, 802 aa, Arabidopsis thaliana
  G386,HB domain coordinates 133-193
MNFGSLFDNTPGGGSTGARLLSGLSYGNHTAATNVLPGGAMAQAAAAASLFSPPLTKSVYASSGLSLALEQPERGTNRGEASMRNNNNVGGGGDTFDGSVNRRSREEEHESRSGSDNVEGISGEDQDAADKPPRKKRYHRHTPQQIQELESMFKECPHPDEKQRLELSKRLCLETRQVKFWFQNRRTQMKTQLERHENALLRQENDKLRAENMSIREAMRNPICTNCGGPAMLGDVSLEEHHLRIENARLKDELDRVCNLTGKFLGHHHNHHYNSSLELAVGTNNNGGHFAFPPDFGGGGGCLPPQQQQSTVINGIDQKSVLLELALTAMDELVKLAQSEEPLWVKSLDGERDELNQDEYMRTFSSTKPTGLATEASRTSGMVIINSLALVETLMDSNRWTEMFPCNVARATTTDVISGGMAGTINGALQLMNAELQVLSPLVPVRNVNFLRFCKQHAEGVWAVVDVSIDPVRENSGGAPVIRRLPSGCVVQDVSNGYSKVTWVEHAEYDENQIHQLYRPLLRSGLGFGSQRWLATLQRQCECLAILISSSVTSHDNTSITPGGRKSMLKLAQRMTFNFCSGISAPSVHNWSKLTVGNVDPDVRVMTRKSVDDPGEPPGIVLSAATSVWLPAAPQRLYDFLRNERMRCEWDILSNGGPMQEMAHITKGQDQGVSLLRSNAMNANQSSMLILQETCIDASGALVVYAPVDIPAMHVVMNGGDSSYVALLPSGFAVLPDGGIDGGGSGDGDQRPVGGGSLLTVAFQILVNNLPTAKLTVESVETVNNLISCTVQKIRAALQCES

SEQ ID NO: 2191 - DNA, 1320 bp, Flaveria bidentis
  G3860,family:ZF-HB
ctctaacccctttcttccttccatttccatatatggaccactaaccatttccccttaattattattcatggacataccatcaccaccaccaacaaccaccaccaccaccatcaccaccgccaccgccaccagccccgtcaaagatcttgacccagatgcccggatccaacccaatcaacacctcccaccgccgttcaccaacggcgtcctcaagcggctgaagccccgccaccaccagcagcagcagcagcagcagccggtggtggtgagttaccgagagtgtttaaagaaccacgccgcggccatgggcggacatgcggtggatggatgcggtgagtttatgccgtcgccgtcgtcaagtccgaccgacccgacgtcgttaaaatgtgcagcctgcggttgccaccgtaacttccaccgccgtgaccccgacggaccgtttccggccaacccaccggtgcaacacgtgatagaatacaaacctcaccaccgccaccaccctccaccaccgccaccgctaccaattcccctcgccggagttagagaaaacagcgtcagtccggcggattccccatctccaccgccgatctcctcctcctactacccatcagccccacacatgctcttagctctcagctccggcctaccggcaccaccgtcggaaaacgcccaattctccccaattccgatctccggcggcgtaatcgggtcaaactccgccggaaaaaaacgattccgaacgaaattcactcaagatcagaaggagaaaatgcacgagttagcagaacgagttgggtggaagatgcagaagaaagatgaagacttgattatcggattctgcaacgaaatcggagttgataaaggggttttcaaggtgtggatgcataacaacaagatgacgtttggaggtaagaaagattccgacaaccacctagccggaaatgggtcctccggtggtggtcttgatttcttcaacagaaacaaccaccagcaacagcagcagcaacaaccgcagaacaacgacagcgttacgagtggtggtggtgggaatgctatcggaactaatggttcatcatcgtcgtcttaaactcttgattaatcttgattattattatggataataagcctttatttaaatagagatagcaagagagaagaagaatatgaggctgttgtttgttttttcgttttagttaattatatattagaagctttttgttgattaaataattagttaatctttgtttaatccaaatgtggaaagatgtagttgtagtactgctagattttcatgcaataatactatgtttagaaactctc

SEQ ID NO: 2192 - protein, 339 aa, Flaveria bidentis
  G3860,ZF-HB domain coordinates 67-122,220-283
MDIPSPPPTTTTTTITTATATSPVKDLDPDARIQPNQHLPPPFTNGVLKRLKPRHHQQQQQQQPVVVSYRECLKNHAAAMGGHAVDGCGEFMPSPSSSPTDPTSLKCAACGCHRNFHRRDPDGPFPANPPVQHVIEYKPHHRHHPPPPPPLPIPLAGVRENSVSPADSPSPPPISSSYYPSAPHMLLALSSGLPAPPSENAQFSPIPISGGVIGSNSAGKKRFRTKFTQDQKEKMHELAERVGWKMQKKDEDLIIGFCNEIGVDKGVFKVWMHNNKMTFGGKKDSDNHLAGNGSSGGGLDFFNRNNHQQQQQQQPQNNDSVTSGGGGNAIGTNGSSSSS

SEQ ID NO: 2193 - DNA, 967 bp, Flaveria bidentis
  G3861,family:ZF-HB
gtttatgccgtcgccggcggcaactccggccgaccccacgtcgatcaaatgcgctgcctgcggctgccaccgtaacttccaccgccgtgaacccgacgcatcgtttccgatcaacccatcgccaccggtgcagcacgttatagactaccaaccccaccaccgccaccacccaccgccaccacaaccaccaccaccaccgcggccgatctccgtcgccggagtattggaaaccagtgtaagtccgccggattccccatctccaccgccaatctcctcctcttacatgctgttagccctcagctctggcttatcagccccaccgccggagatcacccacaacccccaaatctccaccggaatcggagcaattggagcaaattccaccggaaaaaagcgatttcggacgaaattcactcaagatcagaagcaaaagatgcacgaattggcggaacgtgtgggatggaagatgcagaagaaagatgaagatctgattatcaatttctgcaacgaaattggggtcgataaaggggttttcaaggtgtggatgcataataacaagatgacgtccgccggaaaaaaagactccgcccaccagctcgttgacagtggatcctccggcgccggcggtggcggcggtggtggtgatttcttgatgagtagaaactaccaccacctacagcagcagcagaataatgatagtggtagcagcggtggtggcggtggtggtggtgatggtggtggtgatgttatcggaactaatggttcatcgtcatcttcttaattaatcatgattatggataataactaataagcgcttgtttaagtagatatagcaagagagaagaacaagggtatgaggctgttgtttttttttatttattaattttggttacttatgttagaatctttttttgttgattatttaattagttgatccttgtttaatccaaataaggaaagttctagt

SEQ ID NO: 2194 - protein, 258 aa, Flaveria bidentis
  G3861,ZF-HB domain coordinates 1-31,129-192
MPSPAATPADPTSIKCAACGCHRNFHRREPDASFPINPSPPVQHVIDYQPHHRHHPPPPQPPPPPRPISVAGVLETSVSPPDSPSPPPISSSYMLLALSSGLSAPPPEITHNPQISTGIGAIGANSTGKKRFRTKFTQDQKQKMHELAERVGWKMQKKDEDLIINFCNEIGVDKGVFKVWMHNNKMTSAGKKDSAHQLVDSGSSGAGGGGGGGDFLMSRNYHHLQQQQNNDSGSSGGGGGGGDGGGDVIGTNGSSSSS

SEQ ID NO: 2195 - DNA, 1225 bp, Triticum aestivum
  G3864,family:AP2
cccacgcgtccgccaagagcgaactgagatcatcctaggaccaggcgcgaccacacaggacaagatgctgctgcttaatccggcgtccgaggcggcggcggcggcgctggacagcatccggcagcagctcctggaggagccaatggcgccggcgcggccggcgtactgccggagcgcgagcttcggcagcctggtggcggaccagtggagcgagtctctcccgttccggcccaacgacgccgacgacatggtcgtctacggtgccctccgcgacgccttctcctgcggctggctccccgacggctccttcgcggccgtcaagcccgagcccctgccctcccccgactcctacgacggctgctgcctcggcagcttcctcgcgtcgccgcccgggctggacgcgccgtgggcggaggaggccgaggtcgcagcgacggcgtcaagggggaagcacttcagaggcgtgaggcagcggccgtggggcaagttcgcggcggagatccgggacccagccaagaacggcgcgcgcgtgtggctcggcaccttcgacagcgccgaggacgccgctgtggcgtacgaccgcgccgcctaccgcatgcgcggctcccgcgcgctcctcaacttcccgctccgcatcggctcggagatcgccgcagccgcgggtcagaagcgtccgtctccccagccagcgagccccgactctcctcctccctcctccagcgcacccgggtcgtcgaagcggagaaagagaggcgaggccgcagcagagtccatgtccatggctctggtgccgcccccgccggtgcaggctccggtccagctgaccctcccagtccagccgtggctcgccaccggcgccgtccagcagctagtgagctgaagcggcgaaagcaacaagtgatcgttctcatgaccgatggccattagttcttccttcatggcttcatgtgttgagcccatggaggaacagagcatcaagatggcgtcaatggcgtaatgcgtcgctcgaagaaaccttgatcagttggaggcaattacgcgccacgccattgtgaaatttgtgtggctccgtgtgaaacttgtcgctagggttagtggcgttggcacagtagcaagtgggtgcagtggaatcccgaagctggtttgtaagaggtggtgagggtgcaggtgcaaaagttgcacagaccttctcctctccaatggagaatcttctttgttaaaaaaa

SEQ ID NO: 2196 - protein, 271 aa, Triticum aestivum
  G3864,AP2 domain coordinates 127-191
MLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAAAGQKRPSPQPASPDSPPPSSSAPGSSKRRKRGEAAAESMSMALVPPPPVQAPVQLTLPVQPWLATGAVQQLVS

SEQ ID NO: 2197 - DNA, 1098 bp, Triticum aestivum
  G3865,family:AP2
cgctcggcgaatcccaagagcgaactcagatcatcctacgaccagacgcgaccacacaggataagatgctgctgcttaatccggcgtccgaggcggcggcgctggacagcatccggcagcagctcctggaggagccggcgcggccggcgtactgccggagcgcgagcttcggcagcctggtggcggaccagtggagcgagtcgctcccgttccgtcccaacgacgccgacgacatggtcgtctacggcgccctccgcgacgccttctcctgcggctggctccccgacggctccttcgcggccgtcaagcccgagcccctgccctcccccgacggctcctacgacggctcctgcctcggcagcttcctcgcgccgccggcgcccgggccggacgcgccgtgggcggaggaggaggccgaggtcgcggcggcggcgtcgagggggaagcacttcagaggcgtgaggcagcggccgtggggcaagttcgcggcggagatccgggacccggccaagaacggcgcgcgcgtgtggctcggcaccttcgacagcgccgaggacgccgccgtggcctacgaccgcgccgcctaccgcatgcgcggctcccgcgcgctcctcaacttcccgctccgcatcggctccgagatcgccgccgccgccgcagccgcgggccagaagcgtccgtctccccagccggcgagccccgactcttcatctccctcctgcagcgcgcccgggtcgtcgaagaggagaaagagaggcgaggccgcggcagcgtccatggccatggctctggtgccgcccccgccggcgcaggctccggtccagctgaccctcccagcccagccgtggctggccgccggcgccgtccagcagctggtgagctgaagcggcgaagcgaccagtgatcgttctcacttctcacgagcgattagttgcttgatgtgttgagcgacgtgaggaacagagcatcaagatgagatgaatggcgcgtaatgcgtcgctcgaagaaaccttcgatcagttggaagcgattacgcgccaaaaaaaaaaaaaaaaaaaaaaaaaaaaaaaaaaaaaaaaaaaaaaaaaaaaaaaaaaa

SEQ ID NO: 2198 - protein, 272 aa, Triticum aestivum
  G3865,AP2 domain coordinates 125-189
MLLLNPASEAAALDSIRQQLLEEPARPAYCRSASFGSLVADQWSESLPFRPNDADDMVVYGALRDAFSCGWLPDGSFAAVKPEPLPSPDGSYDGSCLGSFLAPPAPGPDAPWAEEEAEVAAAASRGKHFRGVRQRPWGKFAAEIRDPAKNGARVWLGTFDSAEDAAVAYDRAAYRMRGSRALLNFPLRIGSEIAAAAAAAGQKRPSPQPASPDSSSPSCSAPGSSKRRKRGEAAAASMAMALVPPPPAQAPVQLTLPAQPWLAAGAVQQLVS

SEQ ID NO: 2199 - DNA, 1205 bp, Zea mays
  G3866,family:CAAT
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 2200 - protein, 185 aa, Zea mays
  G3866,CAAT domain coordinates 30-126
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 2201 - DNA, 1176 bp, Physcomitrella patens
  G3867,family:CAAT
cagcatcctcacatcccgccttcctctgcaccccagatgtcgcatcctggcgccgtcatgcctttacagatgcactacccgcaagcccagcaacagatgatgccgcagcttggtgatcagcagatgcagccgcagcttcattatcagcaaattcagaaacagcagctgtcccagttctggcagcagcaaatgcaggaaatggagcaagtcaatgattttaagacccatcagctaccactggcacgcatcaaaaaaatcatgaagtcggatgaagatgttaagatgatcgcagccgaagctccagtgctgttttcaaaagcttgtgagatgtttattttagaattgacactgcgctcttggattcatacggaggaaaataagcgaaggacactacaaagaaatgatattgcaggggctatcactaggggagacatcttcgactttcttgttgacatcgttccacgtgacgagttgaaggaagaagatttgggtgtgccatggactggtgttccaggggatggttctgtaccttacggaggaatattctatccacccatggctggacagcaaatgcatcattctatgggggctcctgagatgatggttgggcagccaccaaacccacaaatgatgtatcagcctccacagactgcctttgtccccgagcagcagcaacagtgaatgcattaccacctagagaacgctgagcatcgaagacgggacaactcaaggaaagggctatcgcatcgagattctttcgtcacgtgggaatggtatttatcatactgttgctaccatctgtcattcttatggcaaaaggggtcacaggatcaggattttacctttcactacagcgcttttgtgttggctttcaactatattttaaggaaatcgtagctgtaggcggtgatgcgacagttctgagcactgctaattctagcagagtttatgtttggtttagcaagtcatgaagggcacaaagggacccgacccctccatggatctggtagaaatttgtgaatagtgatactagtgcaggcataattattagcatgtgcaggagttgctcttaatgttaggttcgaggatcgggtatccattttcttagtaccattgtttcttttatgtctccctggttttatctttcagactgaaaaaaaaaaaaaaaaaaaaaaa

SEQ ID NO: 2202 - protein, 214 aa, Physcomitrella patens
  G3867,CAAT domain coordinates 53-149
MSHPGAVMPLQMHYPQAQQQMMPQLGDQQMQPQLHYQQIQKQQLSQFWQQQMQEMEQVNDFKTHQLPLARIKKIMKSDEDVKMIAAEAPVLFSKACEMFILELTLRSWIHTEENKRRTLQRNDIAGAITRGDIFDFLVDIVPRDELKEEDLGVPWTGVPGDGSVPYGGIFYPPMAGQQMHHSMGAPEMMVGQPPNPQMMYQPPQTAFVPEQQQQ

SEQ ID NO: 2203 - DNA, 787 bp, Physcomitrella patens
  G3868,family:CAAT
atcccgggcagcgagcacacagctagcaactctttcggagaatactccaggcgaaattggtcggatggccgatagctacggtcacaacgcaggttcaccagagagcagcccgcattctgataacgagtccgggggtcattaccgagaccaggatgcttctgtacgggaacaggatcggttcctgcccatcgcgaacgtgagccgaatcatgaagaaggcgttgccgtctaatgcaaaaatttcgaaggacgcgaaagagactgtgcaggagtgtgtgtccgagttcatcagcttcatcactggtgaggcgtcagataagtgccagagggagaagagaaagacgatcaacggtgacgacttgctgtgggccatgagtacacttggtttcgaagattacgtggagcctctgaaggtttacctacacaaataccgggagctagagggagagaaggcttccacggccaagggtggtgaccagcaaggagggaaagaagggagtcaaggtgttatggggtccatgggtatgtcgggcggaatgaacggtatgaacggtacgatgaacgggaatatgcatggacatggaatcccggtgtcgatgcagatgctgcagcagtcgtacggacaggaggcacctccagggatgatgtattcccctcatcagatgatgccggaataccagatgccaatgcagtctggtggaaaccagcctcgtggagtgtaggaggttccacggcgaggagaatttgaaattggggagattgtcaagggcgtgagggagtgagctcgc

SEQ ID NO: 2204 - protein, 218 aa, Physcomitrella patens
  G3868,CAAT domain coordinates 35-130
MADSYGHNAGSPESSPHSDNESGGHYRDQDASVREQDRFLPIANVSRIMKKALPSNAKISKDAKETVQECVSEFISFITGEASDKCQREKRKTINGDDLLWAMSTLGFEDYVEPLKVYLHKYRELEGEKASTAKGGDQQGGKEGSQGVMGSMGMSGGMNGMNGTMNGNMHGHGIPVSMQMLQQSYGQEAPPGMMYSPHQMMPEYQMPMQSGGNQPRGV

SEQ ID NO: 2205 - DNA, 1347 bp, Physcomitrella patens
  G3870,family:CAAT
ggcaccagcgaatccgtctccgcctccgccttctgcacgcgtggttgtggtcgacctctcgccggagcaacaggaaactaatcccttttccagcactaaacgattgaagcaattttttttttcttgtgaactgctcactctctctctgttatgaggggattcgaagcttgaaagttatgagctgaaggttgaggacacgtaagagcgaaggacgatcatactacaattaacccttgcggggaaaagcccaggcaaaataggacggatggccgacagttacggccacaacgcaggttcacccgagagcagcccgcattctgataacgagtccggcggccattaccgtgatcaggacgcttctgtacgggagcaagaccggtttttgcccatcgcaaatgtgagccgaatcatgaagaaagcattgccatctaatgcgaagatatcgaaagacgccaaagagactgtgcaggagtgcgtatccgagttcatcagtttcattactggtgaggcgtccgacaagtgtcagagggaaaagaggaagacgatcaacggggatgacttgctgtgggccatgagtactcttggttttgaagattatgtggaacctctgaaggtgtacctacacaagtatcgtgaactggagggggagaaggcctctatggccaagggtggtgatcagcagggaggaaaagagagcaaccaaggaggtatggggtcgatgggcatggcaggcggaatcaacggcatgaacggaacgatgaacgggaacatgcatgggcatggaattcccgtatcgatgcagatgatgcaacagccgtacgcgcagcaggcacctccggggatgatatattctcctcatcaaatgatgccgcaataccagatgccgatgcagtctggtggaaaccaaccccgcggagtgtaagagttttcactggcaggaggctttggaagtggggatattgtcgacagcgtgatggggtgttttggagcatgggcagggcattatggtgctgttgaaacagtgatgggtgggtcatgtgaagtgttggcgactgttgaatgatgaaaacatagaagtgatgtcgttgaagctcggggagtttcaagtgaaaggaggagcactttttgtttggaaaggagcgtaccgggtctggcagtgtacattctgaatgatagttatctgtgctgatttttcttggccttggcaatacgagggggttgaatattttgctttgaattcgttgacatttcaaccttttctatgtgaaaaggctctgtaggatgcaagataaggaaagacatgcagattgataaaaaaaaaaaaaaaaaaaaaaaaaaaaaaaaaaa

SEQ ID NO: 2206 - protein, 218 aa, Physcomitrella patens
  G3870,CAAT domain coordinates 34-128
MADSYGHNAGSPESSPHSDNESGGHYRDQDASVREQDRFLPIANVSRIMKKALPSNAKISKDAKETVQECVSEFISFITGEASDKCQREKRKTINGDDLLWAMSTLGFEDYVEPLKVYLHKYRELEGEKASMAKGGDQQGGKESNQGGMGSMGMAGGINGMNGTMNGNMHGHGIPVSMQMMQQPYAQQAPPGMIYSPHQMMPQYQMPMQSGGNQPRGV

SEQ ID NO: 2207 - DNA, 489 bp, Glycine max
  G3873,family:CAAT
atgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttag

SEQ ID NO: 2208 - protein, 162 aa, Glycine max
  G3873,CAAT domain coordinates 29-118
MSDAPASPCGGGGGGSHESGEHSPRSNFREQDRFLPIANISRIMKKALPPNGKIAKDAKETVQECVSEFISFVTSEASDKCQREKRKTINGDDLLWAMTTLGFEEYIDPLKVYLAAYREIEGDSKGSAKGGDASAKRDVYQSPNGQVAHQGSFSQGVNYTNS

SEQ ID NO: 2209 - DNA, 1109 bp, Glycine max
  G3874,family:CAAT
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcacaataatgtatgaagaaggctcgagcttcttttataaaaaaaaaaaaaaag

SEQ ID NO: 2210 - protein, 171 aa, Glycine max
  G3874,CAAT domain coordinates 25-114
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 2211 - DNA, 818 bp, Glycine max
  G3875,family:CAAT
cttaacatttccctaaacataactcacacacccctcttctctagggtttcaatttcaccatgtttccctttctcaaattagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcct

SEQ ID NO: 2212 - protein, 171 aa, Glycine max
  G3875,CAAT domain coordinates 25-114
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 2213 - DNA, 557 bp, Zea mays
  G3876,family:CAAT
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 2214 - protein, 178 aa, Zea mays
  G3876,CAAT domain coordinates 30-119
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 2215 - DNA, 719 bp, Gossypium raimondii
  G3883,family:CAAT
gttcaccagccaatggacagtaaccagcaaactcaatccaccccatacccacctcagcctcccacatccgccattacccctccttcatccgccacagcaacagcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactgctttggctccgatggtcggtgctaccgccagtggggtaccttacttttatccccctatgggtcaacctgctggtggtggtcctggtgggatgatgattggccggcctgccgtcgatcccaccggagttatttacggtcagccaccttctcaggcttggcagagtgtttggcagacggcggggactgatgatggctcgtatggcagtggagttaccggtggtcaagggaatcttgacggtcaaggctaacctaa

SEQ ID NO: 2216 - protein, 233 aa, Gossypium raimondii
  G3883,CAAT domain coordinates 54-150
MDSNQQTQSTPYPPQPPTSAITPPSSATATAPPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKDETALAPMVGATASGVPYFYPPMGQPAGGGPGGMMIGRPAVDPTGVIYGQPPSQAWQSVWQTAGTDDGSYGSGVTGGQGNLDGQG

SEQ ID NO: 2217 - DNA, 929 bp, Nicotiana benthamiana
  G3884,family:CAAT
taaaatagaaaaaatcgccggtgaaccacctcgtctaaaacgccaatggaaaacaatcagcaatcggcggcgaatgcagcggcggcggcagcagcagcagctgcatatccagcgcagccaccgtaccaccatctccttcagcaacagcaacagcagctccagatgttctggacctaccagcgccaagaaatcgaacaggttaacgatttcaagaaccaccaacttcctcttgcccgaatcaagaagatcatgaaagctgacgaggatgtccgcatgatctccgctgaagctcccattttattcgccaaagcgtgtgagcttttcattctggaactcactattcgttcctggcttcacgctgaggaaaacaagcgtcgaactttacaaaagaacgacatagctgcagcgattacgcggactgacatttttgatttccttgttgacattgttccgagggatgagatcaaggaagagggtggtgttggtcttgggcctgctgggattgtgggctccacagctagtggtgtgccttactattacccaccaatgggccagcctgctccaccgggtgtgatgatgggcaggcctgctatgcctggggttgatccttcaatgtacgttcagccaccgccgtcgcaggcgtggcagtccgtttggcagactgctgaggataattcctatgcaagtggaggcagcagtggacagggtaaccttgatggtcaaagttaatgatcatgtttgctgctgatccagtcgctttgtggcacaaaggaagctattagttactaatggtacatgtccacaaatgtgaatgatccttattgctagtgtccatgaatactagcttaactgtaatgacttgaatcctttagtcgtcttgtttgtataaaactgtttagtttatcagaatgctggtggatttctggttt

SEQ ID NO: 2218 - protein, 227 aa, Nicotiana benthamiana
  G3884,CAAT domain coordinates 47-143
MENNQQSAANAAAAAAAAAAYPAQPPYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEGGVGLGPAGIVGSTASGVPYYYPPMGQPAPPGVMMGRPAMPGVDPSMYVQPPPSQAWQSVWQTAEDNSYASGGSSGQGNLDGQS

SEQ ID NO: 2219 - DNA, 910 bp, Solanum tuberosum
  G3885,family:CAAT
cacagatagtagcttccattttccgcaaaccgccatggacaacaaccctcaccaatctccgactgaggccgccgccgcggcagcagcagcggcagcggcggctcagtcagccacatatccaccgcagactccataccaccatctccttcaacaacaacagcaacagcttcagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccggttctgtttgcgaaagcctgtgaacttttcattctggagctcaccatccgttcttggcttcacgctgaggaaaacaagcgcaggactctacagaagaatgacatcgctgcggcgattactcgtactgatatttttgattttctggttgacatcgttcctagggatgagattaaggatgagggtgttgtgcttggacccggaattgtgggttctactgctagtggtgtgccgtactattaccctccgatgggccagccggctccgggtggggtgatgcttggtaggcctgctgttcctggggttgatccgtcaatgtatgtgcaccctccgccatcacaggcgtggcaatctgtgtggcagactggagacgataattcctatgctagtggaggtagcagtggacagggtaaccttgatggccaaatttaaaagatctcgctgctgccggtttggaggcttaacagcacatgtgaaactaatggttatgatagtgaaatgtaatttcttctctcaaatgtgaatccaccttttatggcttctgtccatggatactgtttaactgtaaccgacttgaatctttgtctgtataaaacttgacttttgtgt

SEQ ID NO: 2220 - protein, 232 aa, Solanum tuberosum
  G3885,CAAT domain coordinates 54-150
MDNNPHQSPTEAAAAAAAAAAAAQSATYPPQTPYHHLLQQQQQQLQMFWTYQRQEIEQVNDFKNHQLPLARIKKIMKADEDVRMISAEAPVLFAKACELFILELTIRSWLHAEENKRRTLQKNDIAAAITRTDIFDFLVDIVPRDEIKDEGVVLGPGIVGSTASGVPYYYPPMGQPAPGGVMLGRPAVPGVDPSMYVHPPPSQAWQSVWQTGDDNSYASGGSSGQGNLDGQI

SEQ ID NO: 2221 - DNA, 750 bp, Glycine max
  G3886,family:CAAT
attgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaact

SEQ ID NO: 2222 - protein, 229 aa, Glycine max
  G3886,CAAT domain coordinates 59-155
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDAALVGATASGVPYYYPPIGQPAGMMIGRPAVDPATGVYVQPPSQAWQSVWQSAAEDASYGTGGAGAQRSLDGQS

SEQ ID NO: 2223 - DNA, 760 bp, Zea mays
  G3889,family:CAAT
cccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtga

SEQ ID NO: 2224 - protein, 244 aa, Zea mays
  G3889,CAAT domain coordinates 54-152
MDNQPLPYSTGQPPAPGGAPVAGMPGAAGLPPVPHHHLLQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 2225 - DNA, 1986 bp, Arabidopsis thaliana
  G389,family:HB
atggaaacgaaagacaagaaagaaaaaggacatatggttttaaattccgacaacgttttcggttcggtgtcttcgtctccgacaacaacaatccaaaaccctaattactttacctccttcgagaaccctaatttcccttacatttttccgaaagaagagtatgaggtgatgagcaagatcgaaagcgggtcgggtaagtcaaccgggtcgggtcatgacccagtggagaatactgcaatcgaacaagagcctcctgcggcgaagaagaaacgttaccatagacatactgctagtcagattcaacaaatggaagcattgtttaaggaaaatgctcatccggataccaaaacaagattgagattaagtaaaaaacttggtctctcgccgatacaagtcaagttttggtttcaaaacaaacgtacccaaatcaaggcacaacaaagtagaagcgataatgcaaagctaaaagcagagaatgagactctaaagacagagagtcaaaatattcagtccaattttcaatgccttttttgctctacttgtggccacaatctccgcctcgaaaacgctcgcctccgccaagagcttgatcgtttacgcagcattgtttccatgaggaatccttctccttcacaagagattaccccggagactaataagaacaacaacgataatatgttgattgcggaagaagaaaaggcgattgatatggaacttgcagtttcttgtgctcgagaattagcaaagatgtgtgacataaatgagcccttgtggaataagaagagactagacaatgagagtgtgtgtctgaatgaggaagagtataagaagatgttcttatggcctctaatgaatgatgatgatcgttttcgcagagaagcttcaagagctaatgcagtcatcatgttgaactgcataaccctcgtcaaagcattccttgatgctgataaatggtcggaaatgttcttccccatagtctcaagcgccaaaacggctcagatcatttcttctggagcttctggaccaagtggtactcttcttctgcaaaatgctgaagaaggaaaatggatggttgtagatttcccgatcgataggatcaaaccagcatcagctactactactgatcaataccggagaaaaccttctggttgcatcattcaagcaatgcgtaacggatactctcaggtcacatgggtagagcacgtagaagtagaagagaagcacgtgcaggacgaggttgttagagagtttgtggagagcggtgtggcctttggcgctgaacggtggctatctgtgttgaagagacaatgtgaaaggatggctagtctcatggctacaaacatcactgaccttggaggtatatatataacttgtttcacaatgataccttctgtagaagcgaggaagaacttgatgaagctgtcacagagaatggtgaaaactttctgtctgaacataatcaattcacacggacaagcaccaacaaaggacacagttaaaatcgtaagcaggaaagtttgcggtggtcttgttccttgtgccgtgtcagtcacgcttctcccttattctcatcaacaagtctttgatcttctccgcgacaatcaacgtctctctcaggtggagagcaattcatcgcataatgtagagttgatgcttcaagaaacatgcaccgataactccgggagtctcctggtgtactctaccgtcgaccccgtcgctgttcagctcgccatgaacggcgaagatccttctgaaataccacttttgcccgttggattctctgttgttccagtgaatccatccgatggtgtcgagggcagttccgtcagttcgccttcgtgcttgctcactgttgcaatacaggtcttggggagcaacgtcaccaccgaaagactcgatctttccaccgtctccgtcatcaatcaccgtatttgcgccactgtcaaccgtatcacttccgcgctcgtcaacgacgtcggtaattaa

SEQ ID NO: 2226 - protein, 661 aa, Arabidopsis thaliana
  G389,HB domain coordinates 84-147
METKDKKEKGHMVLNSDNVFGSVSSSPTTTIQNPNYFTSFENPNFPYIFPKEEYEVMSKIESGSGKSTGSGHDPVENTAIEQEPPAAKKKRYHRHTASQIQQMEALFKENAHPDTKTRLRLSKKLGLSPIQVKFWFQNKRTQIKAQQSRSDNAKLKAENETLKTESQNIQSNFQCLFCSTCGHNLRLENARLRQELDRLRSIVSMRNPSPSQEITPETNKNNNDNMLIAEEEKAIDMELAVSCARELAKMCDINEPLWNKKRLDNESVCLNEEEYKKMFLWPLMNDDDRFRREASRANAVIMLNCITLVKAFLDADKWSEMFFPIVSSAKTAQIISSGASGPSGTLLLQNAEEGKWMVVDFPIDRIKPASATTTDQYRRKPSGCIIQAMRNGYSQVTWVEHVEVEEKHVQDEVVREFVESGVAFGAERWLSVLKRQCERMASLMATNITDLGGIYITCFTMIPSVEARKNLMKLSQRMVKTFCLNIINSHGQAPTKDTVKIVSRKVCGGLVPCAVSVTLLPYSHQQVFDLLRDNQRLSQVESNSSHNVELMLQETCTDNSGSLLVYSTVDPVAVQLAMNGEDPSEIPLLPVGFSVVPVNPSDGVEGSSVSSPSCLLTVAIQVLGSNVTTERLDLSTVSVINHRICATVNRITSALVNDVGN

SEQ ID NO: 2227 - DNA, 881 bp, Solanum tuberosum
  G3892,family:CAAT
ctctttgattgaaccctagctctcactctctctttctctctctaaaaaaagcataaaagtttcaatctttcaggtaatttgattggagaggcgaatccagattttggagcttcaatcagtgggagcccacagcctaaggtagccttgaattctccaaaagggaatcttgctcaaaatggatcatcatggaaatggacagcctccagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataactaggactgacatatttgatttcttagttgacattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgttgatcaagcactttatgcccagcagccccgtccatttatggctcagccaatttggccccagcagcaacaaccaccctcagattcttaagcagctcaaagct

SEQ ID NO: 2228 - protein, 230 aa, Solanum tuberosum
  G3892,CAAT domain coordinates 62-158
MDHHGNGQPPVSAGAIQSPQAAGLSASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPFMAQPIWPQQQQPPSDS

SEQ ID NO: 2229 - DNA, 971 bp, Solanum tuberosum
  G3893,family:CAAT
gatcaatatatcaatcatctacctcttcgattgaaccctagctctcactctctttctctctctaaaaaaagcataaaagtttcaatctttcaggtaatttgattggagaggcgaatccagaatttggagcttcaatcagtgggagcccacagcctaaggtagccttgaattctccaaaagggaatcttgctcaaaatggatcatcatggaaatggacagcctccaggtattggagtcgttactagctcagctccaatatatggtgctccataccaagctaaccaaatggcagggcctcctgcagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataacaaggactgacatatttgatttcttagttgatattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtttgatcagctctttatgcccagcagccccgtccatatatggctcagccaatttggccccagcagccacaaccaccctcagaatcttaagcagc

SEQ ID NO: 2230 - protein, 228 aa, Solanum tuberosum
  G3893,CAAT domain coordinates 88-184
MDHHGNGQPPGIGVVTSSAPIYGAPYQANQMAGPPAVSAGAIQSPQAAGLSASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPV

SEQ ID NO: 2231 - DNA, 1221 bp, Solanum lycopersicum
  G3894,family:CAAT
tatcaatcatctacctctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtgatttaaaagtaaaaaaaaaaaaaaa

SEQ ID NO: 2232 - protein, 258 aa, Solanum lycopersicum
  G3894,CAAT domain coordinates 90-186
MDQHGNGQPPGIGVVTSSAPIYGAPYQANQMAGPSPPAVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 2233 - DNA, 921 bp, Medicago truncatula
  G3896,family:CAAT
ttcgcacttttgtctctcagaggctctcagttttcgtggaaccaagcttcgttttttgagggaagaatggaccatcaagggcataaccagaatccgcaaatgggggttgtcggtagtggcagtcaaatgccatacggatctaacccatatcaatcaaaccaaatgactggggccccaggatcagttgttacatcagttgggggcatgcagtccactggtcaacctgctggagctcagctgggtcagcatcaacttgcttaccagcatatccatcagcagcaacagcagcaacttcagcaacagctgcaatccttctggtcaaaccagtaccaggaaatcgaaaaggttactgatttcaagaaccacagccttcctctggcaaggatcaagaagatcatgaaggctgatgaggatgttagaatgatatcagctgaagcacctgtcatatttgcaagggcctgtgagatgttcatattggagttaaccctgcgctcatggaaccacactgaggagaacaaaaggaggacacttcagaagaatgatattgctgctgcaatcactaggactgatatctttgatttcctggttgacattgtgcctcgtgaggacctgaaagatgaagtgctggcttcaattccaagaggaacaatgcctgttgctgggcctgctgatgctcttccttactgctacatgccacctcagcatgcctcccaagttggaactgctggtgtcataatgggcaagcctgtgatggacccaaacatgtatgctcagcagccccatccctacatggcaccacaaatgtggccacagcctccggaacagcgaccaccatctccagatcactagatgctgagatgtggatgttaaggtaaacttttgactctctctctttagttagttgtagagagtttgagttaa

SEQ ID NO: 2234 - protein, 260 aa, Medicago truncatula
  G3896,CAAT domain coordinates 89-185
MDHQGHNQNPQMGVVGSGSQMPYGSNPYQSNQMTGAPGSVVTSVGGMQSTGQPAGAQLGQHQLAYQHIHQQQQQQLQQQLQSFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGTAGVIMGKPVMDPNMYAQQPHPYMAPQMWPQPPEQRPPSPDH

SEQ ID NO: 2235 - DNA, 2526 bp, Arabidopsis thaliana
  G390,family:HB
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 2236 - protein, 841 aa, Arabidopsis thaliana
  G390,HB domain coordinates 18-81
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 2237 - DNA, 2559 bp, Arabidopsis thaliana
  G391,family:HB
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 2238 - protein, 852 aa, Arabidopsis thaliana
  G391,HB domain coordinates 25-85
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 2239 - DNA, 1959 bp, Oryza sativa (japonica cultivar-group)
  G3924,family:CAAT
gactggatcctgattggcgttgcggccaatcaggatcctgctggatcctgattggatcctgattggcgttgcggccgtgtctctactgttgttgttgttgtgttttttttttcttttttacctttttttgccgccttggttttgatgcggagtctggatgtttctacttttggatggggtttttttaccttacccgaccgaattcgtgggtggattggatgcggttcatggaagggaacgggatcttggtcggctactcggatggggggtttgccggccggttgggatttcgggaaccggatcgaggaagaggcggaggagaattgatccgcggcggcggcggcggaggaggaggagagaatatgtggtgattttcatctgagcccggttgcagaagtccaactgtatcggagaatcttactcggttcgtactacagtcccccacgctggtattcaaggaatcttctctggatggaccagttcttggttggtcccggttctttcatgtccagttccccatggtggttcagttggcagttgtgccctagttgttgtaggagtaattgtcggtggctttaaatggttcatgctcgtcagttcttccgagcattccgaggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactgatcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtggcttctgtccaccggcattcactcttgagggtggattcttgctccagaattgtgctgccatctttcaaatgatcttcatcgtgcaaagtaattatatgtacattcctctgaatgatctatgcaccaattgttgatcctggcagggtaataatctggatgtattgagtccatcacagtgcgaatgtcacgggtagatctgctgttttcaggcaattcattcttggctttctatcccacccgttgttgttgcaagttaagctagcagtacttgtctcagtgtccgtgagacgtttgtgtaagattaggttaaactagaagttgtaatgctgtattaagtgtttgtatttctaatatgaaccgtaacaaggccagagcagaactcgttatacatacaaaaattgatggccaggtcagtgttaccgtattattatgcaatggcagaagcttgcataaggcgtggtgccactcgttgctttgctgtatgtttttgagtttcattcgatttattttcactgttgagtttgtgggt

SEQ ID NO: 2240 - protein, 258 aa, Oryza sativa (japonica cultivar-group)
  G3924,CAAT domain coordinates 163-222
MESRPGGTNLVEPRGQGALPSGIPIQQPWWTTSAGVGAVSPAVVAPGSGAGISLSGRDGGGDDAAEESSDDSRRSGETKDGSTDQEKHHATSQMTALASDYLTPFSQLELNQPIASAAYQYPDSYYMGMVGPYGPQAMSAQTHFQLPGLTHSRMPLPLEISEEPVYVNAKQYHGILRRRQSRAKAELEKKVVKSRKPYLHESRHQHAMRRARGTGGRFLNTKKNEDGAPSEKAEPNKGEQNSGYRRIPPDLQLLQKET

SEQ ID NO: 2241 - DNA, 806 bp, Zea mays
  G3929,family:AP2
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 2242 - protein, 131 aa, Zea mays
  G3929,AP2 domain coordinates 6-67
MEDDKKEGKYRGVRKRPWGKFAAEIRDPERGGSRVWLGTFDTAEEAARAYDRAAFTMKGATAVLNFPTSGGSAAAAPGGRTSGGGSSSSTTSSAPASRGRARVPDSEKVELECLDDRVLEELLAEDKYNKN

SEQ ID NO: 2243 - DNA, 444 bp, Arabidopsis thaliana
  G3930,family:MYB-related
attttttttgtttctctcataatatttgtgttcatactgtttcgctgtttccagtacatactaatggataacacaaaccgtcttcgccgccttcactgtcataaacaacccaagttcactcatagctctcaagaagtgagtagtatgaaatgggagtttatcaatatgaccgaacaagaagaagatctcatctttagaatgtacagacttgttggcgacaggtgggatttaatagcaagaagagtggtgggacgtgaggcaaaggagatagagagatactggattatgagaaattgtgactatttctcccacaaatgacgcaaaagtcactctctttaaaaaatctcgagaatctccctgtttttctatttctcatcctcattaaataatttctgtgattgtggacaagaaaagctttattaagttgtcgagtggggttctcct

SEQ ID NO: 2244 - protein, 84 aa, Arabidopsis thaliana
  G3930,MYB-related domain coordinates 33-77
MDNTNRLRRLHCHKQPKFTHSSQEVSSMKWEFINMTEQEEDLIFRMYRLVGDRWDLIARRVVGREAKEIERYWIMRNCDYFSHK

SEQ ID NO: 2245 - DNA, 1556 bp, Glycine max
  G3934,family:ZF-HB
actcaaaaaccatcatcaacatctcttcaattcttcaattcctctattcctctctcctccctctccttcacttgaacaattccttcttcttttccccctcaattttttctcttcttcaattttagccctacacacaacataaactacaacaacaaacacctaaccattcactcactcacacatttctctctcagttttagcaacagtttgatgaagtcgtcacaaaaagcaacggttttggcttaattattagtattattgttgttattattattacaaggatggagataataacacccacagcaaccgccacaaacgcaaccgcaaaatcgccagaacccgacatagagacgatgacccggatccatcaaaacccgaacccgaatccaaagccggtgtctttctccaacggcgtcttgaagcgccaccatgtaaaccaccgcgccgcggtggtttacaaggaatgcctgaagaaccacgtggcgagcttgggtggccacgctttggacggctgcggcgagttcatgccgtcgccggcggccaccgccgacgaccccagctccatcaaatgcgccgcctgcggctgccaccggaacttccaccgccgcgaaccggaggagtcacccatttctccggcgacacatcacgtcctcgagtacaggccacaccaccgccaccaccctccgccgcctcaccggagtcccaactccgcctccccgccgccgatctcatcctacccctcggcgccccacatgctcctcgccctctccggcggggccggcctctccgtcgcgccggaaaacaccgccgcgccggcgccgccgcaccactcgcgtaaacgcttccggacgaagttcacccaagaacaaaaggagaagatgcacgagttcgcggacaaagttggttggaagatgcagaggcgcgacgaggaaatggttatggagttctgcaacgagattggtgtcgacagaggagttctcaaagtgtggatgcacaacaacaagaacactttcgcgaaaaaagacaaccttaacggcaacagtatcggtaacgttgccattgtcagtgccaacggagttgctcccattggcgccgttggcagcgctaccgttagaagcagcgttcatgtccacgaacatgaacacggaggaattaacggtaacggtagcggcgacaacaaccacaaccccctcggttcccgggatgtgaacgagtacgagaatgatagtgggactaacggcggcggcggtactaatgggtcttcttcttcttcttgaaaaaaaaaatatgagagagaataatgatgtgtttagatgatagagtaattaagaggtggtacccgttaattacttaattagtcgttttcttcttctttcttttttattttgatttaattgtttagtttttgttaattaatgagatgagatgagatgacgatgatgtgatcaccttcttaacatgggagagagatttgattttgatgatattgatatccgcagggaatgtagagttcttgtttgattcagctgcttaattatagttaaatgtttagtgtt

SEQ ID NO: 2246 - protein, 331 aa, Glycine max
  G3934,ZF-HB domain coordinates 57-112,185-248
MEIITPTATATNATAKSPEPDIETMTRIHQNPNPNPKPVSFSNGVLKRHHVNHRAAVVYKECLKNHVASLGGHALDGCGEFMPSPAATADDPSSIKCAACGCHRNFHRREPEESPISPATHHVLEYRPHHRHHPPPPHRSPNSASPPPISSYPSAPHMLLALSGGAGLSVAPENTAAPAPPHHSRKRFRTKFTQEQKEKMHEFADKVGWKMQRRDEEMVMEFCNEIGVDRGVLKVWMHNNKNTFAKKDNLNGNSIGNVAIVSANGVAPIGAVGSATVRSSVHVHEHEHGGINGNGSGDNNHNPLGSRDVNEYENDSGTNGGGGTNGSSSSS

SEQ ID NO: 2247 - DNA, 1196 bp, Zea mays
  G3937,family:CAAT
acacacaaaccagtagccactactccatccatccaccacgagcgcgcgataaccctagctagcttcaggtagtagcgagagccaatggactccagcagcttcgtccctgccgccggcgcggagaatggctcggcggcgggcggcgccaacaatggccgcgttgctcagcagcaggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcacccccactccatgtcgccagcggcgatgctcaagtcccgcgggcccgtctccggagccgccatgctaccgcaccaccaccaacaccaccacgacatgcagatgcacggcgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggtggtggcgggagcgcgtcgcacacaccgcagggcagcggcggcttggagcacccgcacccgttcgcgtacaagtagctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccgatgagattatttcatgcacgctttttagaccg

SEQ ID NO: 2248 - protein, 280 aa, Zea mays
  G3937,CAAT domain coordinates 35-124
MDSSSFVPAAGAENGSAAGGANNGRVAQQQAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHPHSMSPAAMLKSRGPVSGAAMLPHHHQHHHDMQMHGAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 2249 - DNA, 894 bp, Oryza sativa (japonica cultivar-group)
  G3938,family:CAAT
atgaagagtaggaagagctatgggcacttgctgagcccggtgggcagcccgccgttggacaacgagtccggcgaggcggcggcggcggctgcggctggcggcggcggctgcgggagcagcgccgggtatgtcgtctacggcggcggcggcggtggggactcgccggcgaaggagcaggacaggttcctgccgatcgcgaacgtgagccgcatcatgaagcggtcgctgccggcgaacgccaagatctccaaggagtcgaaggagacggtgcaggagtgcgtgtcggagttcatcagcttcgttacaggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgacgtgctcggcggcgccggcggcgccgccgcggcgcgccacggcgagggcggttgctgcggcggcggcggcggcggcgccgatggcgtcgtcatcgacgggcattacccgctcgccggcggcctgtcacactcacaccatggtcatcagcagcaggacggcggcggcgacgtcgggctcatgatgggcggcggcgacgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggcggcggcggcggcgagagggggttcgccggccacctccatggcgtgcaatggtttagactaaagaggaatactaattag

SEQ ID NO: 2250 - protein, 297 aa, Oryza sativa (japonica cultivar-group)
  G3938,CAAT domain coordinates 58-153
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 2251 - DNA, 765 bp, Oryza sativa (japonica cultivar-group)
  G3939,family:CAAT
atggaggccggctacccgggcgcggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgcggccatgtacggtggcggcgcggtgccgccgccgccgcaccctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtag

SEQ ID NO: 2252 - protein, 254 aa, Oryza sativa (japonica cultivar-group)
  G3939,CAAT domain coordinates 31-120
MEAGYPGAAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 2253 - DNA, 1329 bp, Capsicum annuum
  G3957,family:AP2
agttataatacactacttaaattattagagaaaagaaaaagctatgtgtggtggtgcaattatctccgatttggtacctcctagccggatttcccgccggctaaccgccgagttgctatggggtaactctgatctgagcaaaaagaagaaaaatccagggaattattactcaaagcctttgaacaggtctaagtttattgaccttgatgaggaatttgaagctgactttcaggacttcaaggactatgccgatgacgatgttgatgatgttaagcccttcggttccaaatctgtgaaatctggcgattcaagctgcgatactgaaaaatcttccaagagaaagaggaagaatcagtaccgggggatcagacagcgtccttggggtaagtgggcagctgaaattcgtgatccgaggaaagggattcgagtttggcttggaactttcaattctgcggaagaagcagctagagcttatgatgttgaggcacgaaggatcagaggcaagaaggctaaggtgaactttcctgatggatctccagcttctgcttcaagacgtgctgttaagccaaatcctcaggaggcacttcgcgaggaaatcttgaacacagttcagccgaacacaacttatatcaacaacttggacggcggatctgatgattcgtttggctttttcgaagagaaaccagcagcaaagcagtatggctatgagaatgtttcttttactgctggagatatgggactgggttcaatttccccttcaactggtacaacaaatgtttacttcagttctgatgaaggaagcaacacctttgactgctctgatttcggttggggtgaaccatgtccgaggactccagagatctcatctgttctgtcagaagttctagaatgtaatggtactcaatctgatgaagatgctagaccagagaaaaaactgaagtcgtgttccaacgcttccttgccagatgaggataacactgtgcacacgctatctgaagagctatcggcttttgaatcccagatgaagttcttgcagatcccatatcttgagggaaattgggatgcatcagttgatgcctttgtcaacacaggcgcaattcaggatggcggaaatgcgatggatctctggccttcgatgatgttccttctttaatgggaggtgtctataagccaacacgcaccttcccttattaagttttgtaaataaagcttcatttgagtgaagtttgcagttatgttgtctccaaacaaaaaagactatatatgtgttgtattaaatttatttcataaatttacttgtttgatgtaaaaaaaaaaaaaaaaaaaaaa

SEQ ID NO: 2254 - protein, 369 aa, Capsicum annuum
  G3957,AP2 domain coordinates 102-164
MCGGAIISDLVPPSRISRRLTAELLWGNSDLSKKKKNPGNYYSKPLNRSKFIDLDEEFEADFQDFKDYADDDVDDVKPFGSKSVKSGDSSCDTEKSSKRKRKNQYRGIRQRPWGKWAAEIRDPRKGIRVWLGTFNSAEEAARAYDVEARRIRGKKAKVNFPDGSPASASRRAVKPNPQEALREEILNTVQPNTTYINNLDGGSDDSFGFFEEKPAAKQYGYENVSFTAGDMGLGSISPSTGTTNVYFSSDEGSNTFDCSDFGWGEPCPRTPEISSVLSEVLECNGTQSDEDARPEKKLKSCSNASLPDEDNTVHTLSEELSAFESQMKFLQIPYLEGNWDASVDAFVNTGAIQDGGNAMDLWPSMMFLL

SEQ ID NO: 2255 - DNA, 1391 bp, Solanum lycopersicum
  G3974,family:AP2
ttcaaattgagctttttctccattaaaattctctctgcaaatttatagtttttcttttttcactttttgagaagaaatcaaaagctatgtgtggtggtgcaattatctccgatttggtacctcctagccggatttctcgccggttaaccgctgattttctatggggtacatccgatctgaacaagaagaagaagaaccctagtaattaccactcaaagcccttgaggtctaagtttattgaccttgaagatgaatttgaagctgactttcagcacttcaaggataattctgatgatgatgatgatgtgaaggcatttggccccaaatccgtgagatctggtgattcaaactgcgaagctgacagatcctccaagagaaagaggaagaatcagtaccgggggatcagacagcgtccttggggtaagtgggcagctgaaatacgtgatccaaggaaaggtattcgagtctggcttggtactttcaattcagccgaagaggcagccagagcttatgatgctgaggcgcgaaggatcagaggcaagaaagctaaggtgaactttcctgatgaagctccagtgtctgtttcaagacgtgctattaagcaaaatccccaaaaggcacttcgtgaggaaaccctgaacacagttcagcccaacatgacttatattagtaacttggatggtggatctgatgattcgttcagttttttcgaagagaaaccagcaaccaagcagtacggcttcgagaatgtgtcttttactgctgtagatatgggactgggctcagtttccccttcagctggtacaaatgtttacttcagctctgatgaagcaagtaacacttttgactgctctgatttcggttgggctgaaccgtgtgcaaggactccagagatctcatctgttctgtcggaagttctggaaaccaatgagactcattttgatgatgattccagaccagagaaaaaactgaagtcctgttccagcacttcattgacagttgacggtaacactgtgaacacgctatctgaagagctatcggcttttgaatcccagatgaagttcttgcagatcccatatctcgagggaaattgggatgcatcggttgatgccttcctcaatacaagtgcaattcaggatggtggaaacgccatggacctttggtccttcgatgatgtaccttctttaatgggaggtgcctactaagctgcatacacatcttcccctgctaagttttgtaaataacgcttcatttgagtgaagtttgcgcctgcgtttacgtttatcaccaaactaaaagactatatatgtgttgtattaatttattcaaaatttactcgtttgatatatgtaagtatgtatccttgttttcataaaaaaaaaaaaaaaaaa

SEQ ID NO: 2256 - protein, 372 aa, Solanum lycopersicum
  G3974,AP2 domain coordinates 100-162
MCGGAIISDLVPPSRISRRLTADFLWGTSDLNKKKKNPSNYHSKPLRSKFIDLEDEFEADFQHFKDNSDDDDDVKAFGPKSVRSGDSNCEADRSSKRKRKNQYRGIRQRPWGKWAAEIRDPRKGIRVWLGTFNSAEEAARAYDAEARRIRGKKAKVNFPDEAPVSVSRRAIKQNPQKALREETLNTVQPNMTYISNLDGGSDDSFSFFEEKPATKQYGFENVSFTAVDMGLGSVSPSAGTNVYFSSDEASNTFDCSDFGWAEPCARTPEISSVLSEVLETNETHFDDDSRPEKKLKSCSSTSLTVDGNTVNTLSEELSAFESQMKFLQIPYLEGNWDASVDAFLNTSAIQDGGNAMDLWSFDDVPSLMGGAY

SEQ ID NO: 2257 - DNA, 1201 bp, Arabidopsis thaliana
  G398,family:HB
agaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttgtccatgtcttcttgataacaaaaaaatttataattataaaaaaaaaaaacaggataaaaaaaaaaaaaaaaaaaaaaaa

SEQ ID NO: 2258 - protein, 282 aa, Arabidopsis thaliana
  G398,HB domain coordinates 128-191
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 2259 - DNA, 687 bp, Glycine max
  G3980,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattga

SEQ ID NO: 2260 - protein, 228 aa, Glycine max
  G3980,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQVPVNLQLSQPQQQQQHYKASSGTTKLGLQLH

SEQ ID NO: 2261 - DNA, 678 bp, Glycine max
  G3981,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccggaaaatgatgggggaagaactgtcaggcttgacagtcaaagaattacaaaatttggagaaccaattagaaattagccttcgaggtgtccgaatgaaaaaggatcaacttttaatggatgaaatacaagagttaaatcggaagggaaacctcatacaccaagaaaatgtggaactgtatcagaaggtctatggaacaaaagatgataacaaaacaaacagagattctgttctcacaaatggtctaggcataggagaggatttgcaagtgcctgtgaatctccagctaagccagccacagcaacaacactacaaggaaccttcaggaactacaaaattgggattgcaattgcattag

SEQ ID NO: 2262 - protein, 225 aa, Glycine max
  G3981,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRKMMGEELSGLTVKELQNLENQLEISLRGVRMKKDQLLMDEIQELNRKGNLIHQENVELYQKVYGTKDDNKTNRDSVLTNGLGIGEDLQVPVNLQLSQPQQQHYKEPSGTTKLGLQLH

SEQ ID NO: 2263 - DNA, 936 bp, Antirrhinum majus
  G3982,family:MADS
atttcatttgaagagatgggaagggggaagattgtgatccaaagaatcgacaaatcgacgagtaggcaagtgactttttcgaaaaggaggagtggacttttgaagaaggccaaagagcttgctattctttgtgatgcagaagttggagttgttatattttccagcactgggaagctctacgaattttcaagcaccagcatgaaatcaattattgaacgacacactaaaaccaaagaggaccatcatcagctgcttaatcatggctcggaggtcaagttttggcaaagggaggctgcgactttaaggcaacaattacaggatttgcaagaaaaccatcggaagttgatgggagaagagctacaagggttgaatgttgaagatctacacagattggagaaccaactagagatgagtttgcgaggcgtgcgcatgaaaaaggtacagatgttaaccgatgaggttcatgaacttaggagaaagggacatctcatccatcaagagaacaatgagctctatgagaaggtaaaactccttcaacaagaaaacaaggaattgtgtaaaaaggcttacggcacaagggatgtaagtgcagcaaatggaactgccttggttccatttggtttcgcaattggtagggaacaattcgagccaatccagcttcatttaagccagcctgaaccagaaaatattgaaacatcaagagcctcaggatcaaagtaaattatttttggactaccttacaaaactacatgtgcttgtgtatgtatcatccagcactaggcaattaagtaacttgtattttgaatgcacgcctagacattaatatttccaaattgtcacaatattcgacagagctttcatttggcgatacctgcaagaaaattcactgtactcaatttaagagttcatataatgctatgtgtaattgtttttagc

SEQ ID NO: 2264 - protein, 234 aa, Antirrhinum majus
  G3982,MADS domain coordinates 2-57
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 2265 - DNA, 798 bp, Solanum lycopersicum
  G3984,family:MADS
atggctagagaaaaaattcagatcaagaaaatagataactccacagcaagacaagttacattttcaaagaggagaagaggtttattcaagaaagctgaagaactttctgttctctgtgatgctgatgttgctctcatcattttctcttctactggaaaattatttgactattctagctcaagcatgaaacaaattcttgagaggcgtgatttgcattccaaaaatctggaaaaattggatcaaccatcacttgaacttcagcttgtagaaaatagcaactactccagattaagcaaggaaatttccgaaaaaagtcatcgattaaggcaaatgaggggagaagaacttcaaggactaaatattgaagagttgcaacaattggagagatctcttgaaactggattgagccgcgtcatagagagaaagggtgataaaataatgagagagatcaaccaactccaacaaaagggtatgcatctaatggaagaaaatgaaaaattaaggcaacaggtgatggagatatctaataataataataataataataatggatatagagaggcaggagtagtaatatttgaaccagaaaatggatttaataataataataatgaagatggccaatcatctgaatcagtaacaaatccatgtaactcaattgatcctcctcctcaagatgatgatagttctgatacttctctcaaattggggttagctaccttactcaggctgaagagatcaaaagcaaggtgtggctatttttgtatgttattagaagaaggagaaaaaaaaaagtaa

SEQ ID NO: 2266 - protein, 265 aa, Solanum lycopersicum
  G3984,MADS domain coordinates 2-57
MAREKIQIKKIDNSTARQVTFSKRRRGLFKKAEELSVLCDADVALIIFSSTGKLFDYSSSSMKQILERRDLHSKNLEKLDQPSLELQLVENSNYSRLSKEISEKSHRLRQMRGEELQGLNIEELQQLERSLETGLSRVIERKGDKIMREINQLQQKGMHLMEENEKLRQQVMEISNNNNNNNNGYREAGVVIFEPENGFNNNNNEDGQSSESVTNPCNSIDPPPQDDDSSDTSLKLGLATLLRLKRSKARCGYFCMLLEEGEKKK

SEQ ID NO: 2267 - DNA, 1335 bp, Zea mays
  G3985,family:MADS
ttgggaccctcccgcccggccggccccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgccaacttccctactgttttggcgcgccgcaagctgtgctcaagcatgcttcatgtttgt

SEQ ID NO: 2268 - protein, 228 aa, Zea mays
  G3985,MADS domain coordinates 2-57
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWK

SEQ ID NO: 2269 - DNA, 1186 bp, Zea mays
  G3986,family:MADS
aaggatgctgcccctccacgcgccggccttaacttctctgcccgatccccgcgtccgctgatggtggatccactggccgccggttttctccagctggagagccattcgtgggcgtaggacgagagagagaggatcggagcagtacgcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatccttactgaagacgggcagtcgtctgaatctgtaatgactgcattgcattcaggaagctcgctcgactgtgatgatggttcagatatatccttgaagttgtcgttgccttgaaaggaaggaccatcgcatcgcatgttatctgcatgagtggggctgacatcagtgcttctaagaagataaagactgggatagtcccattcgcggcattatattggtttaaccagatgtgctatccttgtgcatgtctgtacttcaaagtggctaacgcgaaatttgtatatataatagtgtatgcgctgcgttatcttcgttctaaaaatctgtattgtttcgttgctggcgctatattgttggtgtattatatatatgcacttagttgttatcaaaaaaagaggaagagcataatatagacacatgatgctaccaaaaaaaaaaaaaaaaaaaaaaaagg

SEQ ID NO: 2270 - protein, 225 aa, Zea mays
  G3986,MADS domain coordinates 2-57
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLP

SEQ ID NO: 2271 - DNA, 1457 bp, Zea mays
  G3987,family:MADS
cccacgcgtccggtctgcctttccctctcccagtttccgtttttttaatgctttgtttactcgcggggatcatggggtaatcgcgtgggccgtgcctggctgggtttatttccttgggtcccccgaggccggccgggcccctttcctgcccctccccctccgcctttcctctctctcgctctcctcctctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgttatacgtgtgtacttattgggaagttgagtctgcatacaacctgaccgccggtgcggtcttgctgtcttacagagagaccgtttagttttc

SEQ ID NO: 2272 - protein, 228 aa, Zea mays
  G3987,MADS domain coordinates 2-57
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADTENVIAEDGQSSESVMTALHSGSSQDNDDGSDVSLKLGLPCVAWK

SEQ ID NO: 2273 - DNA, 1307 bp, Oryza sativa (japonica cultivar-group)
  G3988,family:MADS
cgcggtggcggcgtctaaactagtggatccccggcctgcgggtccccgggctgcagggcctcgcctcgcctcacctcacctcaccctccgcctcgtctccttcccccctttcctcaacccacgcacgccctctctcccatcccagccgtagccgcgccgtgacttgtctcgatcggcggcgaggaggagggcttccgttccctggccggtaggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcaagtatgcacatttgaatgagcaacttgcggaagctagtctccggcttagacaaatgagaggtgaggagcttgagggattgagcattgatgaactccagcagctagagaagaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaaaaaaaaaaaaaaaaaaaaaa

SEQ ID NO: 2274 - protein, 228 aa, Oryza sativa (japonica cultivar-group)
  G3988,MADS domain coordinates 2-57
MARERREIKRIESAAARQVTFSKRRRGLFKKAEELSVLCDADVALIVFSSTGKLSHFASSSMNEIIDKYNTHSNNLGKAEQPSLDLNLEHSKYAHLNEQLAEASLRLRQMRGEELEGLSIDELQQLEKNLEAGLHRVMLTKDQQFMEQISELQRKSSQLAEENMQLRNQVSQISPAEKQVVDTENFVTEGQSSESVMTALHSGSSQSQDNDDGSDVSLKLGLPCGAWK

SEQ ID NO: 2275 - DNA, 1021 bp, Glycine max
  G3989,family:MADS
ccacgcgtccgcggacgcgtgggcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacctaaaaaaaaaaaaaaaaaaaggctaaaaaag

SEQ ID NO: 2276 - protein, 205 aa, Glycine max
  G3989,MADS domain coordinates 2-57
MTRKRIQIKKIDNISSRQVTFSKRRKGLFKKAQELSTLCDADIALIVFSATSKLFEYASSSMHQVIERRDSHSAMNRLDRPSIELQIENDSNEILRKKVEDKNRELRQMNGEDLQGLTLQELHKLEEHLKRGLINVSKVKDEKLMQEISTLKRKGVELMEENQRLKQVVPSLIHVHRQSSESILSNSSNLPEDGGSDTSLKLGLP

SEQ ID NO: 2277 - DNA, 1300 bp, Zea mays
  G3990,family:MADS
gccgggaaaacatagctagggttctccttctcccctccctccgccccctcgagattttcgcgggcccgcttgctcttggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtacccgtataatcaccctgcaattacctgcagctggtcatcgttaggagaaactccagtccatgcaaatgaactcccaaaaaaaaaaaaaaaaaaaaa

SEQ ID NO: 2278 - protein, 233 aa, Zea mays
  G3990,MADS domain coordinates 2-57
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSK

SEQ ID NO: 2279 - DNA, 905 bp, Glycine max
  G3991,family:MADS
acgaagctcggaattcggctcgagctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatgcatcaagtaattgaaaggcacgatcgctattcagcaatccatagattggatcgcccctctattgagctgcagattgagagtgactccaacaacattctgcgcaagaaagtagaagataagactcgtgaactgaggcagatgaatggggaagatctgcaaggattgacattacaagaactgcagaaactagaggaacatcttaaaagaagtttgaccaatgtttcaaaagtaaaggatgcaaaatttatgcaagagatcagctcctttaagagaaagggagtggaactaatggaggaaaaccaaagactgaaacaggtgccgagccttatccatgcacatagctataggcaatcatcggaatccattcttagcaattcatctaaccttcctgaagatggtggtagcaacacatctctcaagttggggttaccttaaataatgaacacaatgtagattatttagaagtgatcggtttcgcttcctttatatgtcagtcaaaaccaattgaatatcctgtgttgtttgctgtttaaaaacaactcgtgtaaagtaagtaaatccaaaggatgaggtcctgcatgtagaattgtgcttgaaaaaaaaaaaaaaagg

SEQ ID NO: 2280 - protein, 206 aa, Glycine max
  G3991,MADS domain coordinates 2-57
MTRKRIQIKKIDNISSRQVTFSKRRKGLFKKAQELSTLCDADIALIVFSATSKLFEYASSSMHQVIERHDRYSAIHRLDRPSIELQIESDSNNILRKKVEDKTRELRQMNGEDLQGLTLQELQKLEEHLKRSLTNVSKVKDAKFMQEISSFKRKGVELMEENQRLKQVPSLIHAHSYRQSSESILSNSSNLPEDGGSNTSLKLGLP

SEQ ID NO: 2281 - DNA, 1190 bp, Glycine max
  G3992,family:MADS
ttggcgctcatcctctctctctttccttcattggtggctttcaacccaaagctgaaatcatctaaacatggcaaaccaaaccgaaccaaaaaccaacattcctaatatcaacgccttcccccaataaggaaagtaaaaatcaacaagtacatccttactcagctctctctttcaacaacatcccaccacacactaacaccaactccaactccaactccaagtcttcccctaactaacaccactaacaacaatcactaaaaaaagaaagaaaatttaccctgatcgcaggatctccgaacaaagctttgatttcacaaaagctaaatttagataaacacctgcatattaaatttttctgctctatacatgcatcacatgtccctcacactaaacaaaagaaaaacaccaccaccctttgcttttgcttttctataagtagtcaacggctcagccttaatttctttgctttttttaggttaaggtacatggtgagggagaagattcagattaagaagatcgacaacgccacggcgaggcaggtcacgttctccaagcgtcgcagagggctcttcaagaaagctgaggagctttcggttatgtgtgatgctgatgttgccctcataatcttctcttccactgggaagctctttgagtactcaagctcaagcatgaaggaaatacttgaaaggcatcatttgcactcaaagaacctagcaaggatggaacaaccatctctcgagttgcagctagttgaaaacagcaactgctccagattgagcaaggaagtggccgaaaagagccatcaactaaggcagctgagaggagaggatcttcaaggcttaaacatagaagaattgcaacaattggagaggtcacttgaaactggattgggccgtgtaatagaaaagaagggagagaagattatgagtgagatcgctgatctccaaagaaaggggatgctattgatggaagagaacgagcgactcaaacgtcacgtggcggggataattaatggccaaaggcatgggtggtgccgaatctgagaactttgttatggatgaagggtcagtcttcggagtctgtcaccgtacggtttgcaattccactgggacccccccaagactatgaaagctcagatacttcgctcaaattggggctaccatactccggctgatgagaaaagtgtgtgg

SEQ ID NO: 2282 - protein, 185 aa, Glycine max
  G3992,MADS domain coordinates 2-57
MVREKIQIKKIDNATARQVTFSKRRRGLFKKAEELSVMCDADVALIIFSSTGKLFEYSSSSMKEILERHHLHSKNLARMEQPSLELQLVENSNCSRLSKEVAEKSHQLRQLRGEDLQGLNIEELQQLERSLETGLGRVIEKKGEKIMSEIADLQRKGMLLMEENERLKRHVAGIINGQRHGWCRI

SEQ ID NO: 2283 - DNA, 726 bp, Brassica rapa
  G3998,family:MADS
atggcgagagaaaagattcagatcaggaaaatcgacaacgcgacggcgagacaagtaacgttctcaaaacgaagaagaggtcttttcaaaaaagctgaagagctctccgttctctgcgacgctgatgttgctctcatcatcttctcttccactggaaagctctttgagttttgtagctccagcatgagggaagtgttagagaggcataacttgcagtcaaagaacttggagaagcttgatcaaccatctcttgagttacagctagtcgagaacagcgatcacgccctgttgagcaaagagattgcggaaaagagccaccaactaaggcaaatgagaggagaggaacttcaaggacttaacatagaagagctgcaacagctggaaaaggcccttgaagctggtttgacgcgcgtgattgaaacaaagagtgagaagattatgagtgagatcagtgaccttcaaagaaagggaatgaaattgatggatgagaacaagcggctaaggcagcatggaacacaactaacagaagagaacgagcgactaggcaagcaaatatataataatatgcatgaaagatacggtggtgttgagtcggagaagaccgccgtgtacgaggaagggcagtcgtcagagtccattactaacgccggaaactccaccggcgctcctgttgactccgagagctccgatacctctcttaggctcggcttaccgtatggtggttag

SEQ ID NO: 2284 - protein, 241 aa, Brassica rapa
  G3998,MADS domain coordinates 2-57
MAREKIQIRKIDNATARQVTFSKRRRGLFKKAEELSVLCDADVALIIFSSTGKLFEFCSSSMREVLERHNLQSKNLEKLDQPSLELQLVENSDHALLSKEIAEKSHQLRQMRGEELQGLNIEELQQLEKALEAGLTRVIETKSEKIMSEISDLQRKGMKLMDENKRLRQHGTQLTEENERLGKQIYNNMHERYGGVESEKTAVYEEGQSSESITNAGNSTGAPVDSESSDTSLRLGLPYGG

SEQ ID NO: 2285 - DNA, 708 bp, Eucalyptus occidentalis
  G3999,family:MADS
atggcgagagaaaagattcagatcaagaagatcaccaatgcgacggcgaggcaagtcactttctcgaagcgacggagaggactcttcaagaaggccgaggagctgtccgtgctttgcgatgccgatgtcgcgctcatcgtcttctcttcttctggaaagctcttcgaatactgcagttccagcatgaaggaaattctcgaacgacatcattcgcactccgagaatcttgggaaactggatcaaccatcacttaagttgcagttagtagaaaacggcgactactctaggttaagcaaggaagttgcagagaaaggtcaccaattgaggcagatgagaggggaagagctccaaggactaaatattgatgaactgcagcagctagagaaatcgctcgaagctgggttgaatcgtgtaatagaaaagaagggtgaaaagatcatgaaagagatcaccgaccttcaacagaagggcgcaaaactaatggaagaaaacaagagactaaagcaacaggttactgaaatctcgggccggaaaaccactgccaccgattcagagaccatcatcaatgaggaaggcctctcgtcggagtccatcacgaacgtctgcagctccagcagcggtcctcctcaggaggatgatagctccgacatttcccttaagctggggttaccctacaatggctgatctgctgtctaaatctacaacaat

SEQ ID NO: 2286 - protein, 227 aa, Eucalyptus occidentalis
  G3999,MADS domain coordinates 2-57
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEENKRLKQQVTEISGRKTTATDSETIINEEGLSSESITNVCSSSSGPPQEDDSSDISLKLGLPYNG

SEQ ID NO: 2287 - DNA, 929 bp, Arabidopsis thaliana
  G40,family:AP2
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 2288 - protein, 213 aa, Arabidopsis thaliana
  G40,AP2 domain coordinates 45-112
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 2289 - DNA, 375 bp, Glycine max
  G4019,family:Z-CO-like
atgtgcaaaggtgcagaaggagaaaagcaacatggtttctgcagcagctttctacataaagaatgtgcaaccagaagtgctacatgttgtgagctatgtgggttacaggcttcattgtattgtcaagctgatgatgcatacttgtgtagaaaatgtgataaaagggttcatgaagctaattttttggcccttaggcacattaggtgctttctgtgcaacacatgtcaaaaccttacgcgaagatatctcattggagcatcaatagaggtggttcttccagccaacattaactggaccattggaaatctccctagcaacagaggaatccacagaaagtgctcaagaatgcataacaacctttccctcttgttataa

SEQ ID NO: 2290 - protein, 124 aa, Glycine max
  G4019,Z-CO-like domain coordinates 30-75
MCKGAEGEKQHGFCSSFLHKECATRSATCCELCGLQASLYCQADDAYLCRKCDKRVHEANFLALRHIRCFLCNTCQNLTRRYLIGASIEVVLPANINWTIGNLPSNRGIHRKCSRMHNNLSLLL

SEQ ID NO: 2291 - DNA, 960 bp, Oryza sativa (japonica cultivar-group)
  G4060,family:MADS
atggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccagcatggaacagattattgaccggtacaactcgcattccaagacacttcagagagcagaaccttctcaactcgacttacaaggggaggacagcagtacttgtgccagactaaaggaggagcttgcagaaactagccttaggctgaggcagatgagaggagaggagctgcacaggctgaatgtggaacagctgcaggagctagagaagagcctcgagtccggtctaggctctgttctcaagaccaagagcaagaaaattctggatgagatcgatggactggaacgaaagaggatgcaattgatagaggagaatttaaggctgaaggagcaagtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaagctcgggttgcactcttaactccaagtgatggctggaaactaaaactgagaggaaacagctggatggcatgcctgcatcgccaaatgatcagtgcatgcactggaagactgaaacaaataacacaaggtttagattgccagaagatgatgtgtgtgtgctgaaaagtaactggctattatcggacaccataataaccattgaaccgaaaaaaggcttttggaccttggaagggaccggaaacta

SEQ ID NO: 2292 - protein, 244 aa, Oryza sativa (japonica cultivar-group)
  G4060,MADS domain coordinates 2-57
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQVSRMSRMEEMQPGPDSEIVYEEGQSSESVTNASYPRPPPDNDYSSDTSLKLGLHS

SEQ ID NO: 2293 - DNA, 714 bp, Solanum lycopersicum
  G4061,family:MADS
cccggaaaatcggaatttaaatggtgagaggaaaagtagaaatgaaaagaatagaaaattcaacgagcaggcaagtgacgttttcgaaaagacgaaatggacttacgaagaaagcttatgaattatcagttctttgtgatgctgaagttgctttcattattttctcacataaaggaagactttatgaatttgctagctccaacatgcagaagataattgagagataccgaggacgtgcaagagaaacaacgacggtggacaaaagcactgaactcgagcactacatggagaacttgaagcatgaaacagctaatatggcgaagaagatagagatcctcgaaatttctaaacggaagctaatggggcaaggattagggtcatgttcaatggatgaactagaagacattgacagccaactggagaggaccctcaaaattatcagggctagaaagactcaattgttcaaagaggaaatagaaagtctaaaagcaaaggagagactattgctccaacaaaatgcaagtttacgtgaaaagtgcgggcttaggccaatgctatcagagtcagcatctgcacccgaacccataccagcaccaccatcaacaccaccagctcaatcaaaagaaaggggaaattgtagccaaagtacaaagagttgggaagtggagactgaattgtttattggccttcctcaaacgcgctgcttatagtagc

SEQ ID NO: 2294 - protein, 229 aa, Solanum lycopersicum
  G4061,MADS domain coordinates 2-57
MVRGKVEMKRIENSTSRQVTFSKRRNGLTKKAYELSVLCDAEVAFIIFSHKGRLYEFASSNMQKIIERYRGRARETTTVDKSTELEHYMENLKHETANMAKKIEILEISKRKLMGQGLGSCSMDELEDIDSQLERTLKIIRARKTQLFKEEIESLKAKERLLLQQNASLREKCGLRPMLSESASAPEPIPAPPSTPPAQSKERGNCSQSTKSWEVETELFIGLPQTRCL

SEQ ID NO: 2295 - DNA, 642 bp, Brassica rapa
  G4062,family:MADS
atggtgaggggcaaaactcagatgaagcgaatagagaatgcaacaagcagacaagtgactttctctaagcgaaggaatggtttgctgaaaaaagcctttgagctctcagttctttgtgatgctgaagtttctctgatcatcttctctcctaaggcaaaactttatgaatttgccagctccaatatgcaagataccatagatcgttatctgaggcataccaaggatcgtgtcagcaccaaacctgtttctgaagaaaatttgcagcatttgaaacatgaagcagcaaacatgatgaagaaaattgaacaacttgaagcttccaaacgtaaactcttgggagaaggcataggatcatgttcgatagaggagctgcagcaaattgagcaacaacttgagaaaagtgtcaaatgtatccgagcaagaaagactcaagtgtttaaggtacaaattgagcagctcaagcaaaaggagaaagctctagctgcagaaaacaagaagctcactgaaaagtggggatctcatgaaatcgaagtctggtcgaataagaaccaagaaagtggaagaggtgacgaagagagtagcccaagttctgaagtagagacagagttgttcattgggttaccttgttcttcaagaaagtga

SEQ ID NO: 2296 - protein, 213 aa, Brassica rapa
  G4062,MADS domain coordinates 2-57
MVRGKTQMKRIENATSRQVTFSKRRNGLLKKAFELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKVQIEQLKQKEKALAAENKKLTEKWGSHEIEVWSNKNQESGRGDEESSPSSEVETELFIGLPCSSRK

SEQ ID NO: 2297 - DNA, 976 bp, Glycine max
  G4063,family:MADS
ggctcgaggttttctgttttggaccatggacttggtttttaccaaatcaagaaaaggatgagcttttttgggccttcaaatcttgcttggagaaggctcaattttggtggaaacctctcacacaagaaagcatagtttcttttgggttcattctacttggtgtttagagatggtgagaggaaagactcagctgaggcgcatagagaacgccacaagcaggcaagtcaccttttcaaagcggcgtaatgggttgctgaagaaggcctttgaactttctgttctttgtgatgctgaggttgctctcatcattttctctccaagaggaaagctttatgaatttgcaagctcaagcatgcaggacacaattgaacgataccgcaggcataacaggagtgctcaaacagtgaacagatctgatgaacaaaatatgcagcatttgaagcaagaaacagcaaacttgatgaagaagattgagcttcttgaagcttcaaaacggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattgaacataatttaatccttgcctatgcaaatatcaaataagaagcccaactgcaatgtataaatatcacatgtttcctaatactgagatgaataatattatcgcttgtattatataaagaactttctagccttatgattagggtttaattattaaaaaaaaaaaaaaaaaaagg

SEQ ID NO: 2298 - protein, 211 aa, Glycine max
  G4063,MADS domain coordinates 2-57
MVRGKTQLRRIENATSRQVTFSKRRNGLLKKAFELSVLCDAEVALIIFSPRGKLYEFASSSMQDTIERYRRHNRSAQTVNRSDEQNMQHLKQETANLMKKIELLEASKRKLLGEGLGSCSLEELQQIEQQLERSVSSVRARKNQVYKEQIDQLKEKERALYAENARLCEQYGGIQPQPATKDPKEIQPYAESSPSSEVETELFIGLLRSSY

SEQ ID NO: 2299 - DNA, 1367 bp, Glycine max
  G4064,family:MADS
ctgttttggaccatggacttggtttttaccaaatcaagaaaaggatgaggtttcaatttttctattaccataaaacaattttgtttcttaatatggtgaggctgggggaatcaccgggggataggtggatgaataaggaaagcttggtctgattagtctatactatatgccttgctattcccctttttctgagtttctctctgcacttcttgctagctaccctctcttttggggtatttcttttcattctccaaaaactctttaattttccttcccttttctgtgctattctctcctcactggtcaaaaggtttgtgggattttgctaatttggtgcaaatctgattcctttgacaaatccctcttgatctcctggcttattgaaaactactacaattccgagttgctttttttccctagttgcttttctgggccttgaaatcttgcttggagaaggctcaattttggtggaaacctctaccacaagaaagcatagtttttttgggttaatcatacttgaggtgtttagagatggtgagaggaaagactcagatgaggcgcatagagaacgccacaagcaggcaagtcaccttctcaaagcggcgtaatgggttgctgaagaaggcctttgaactttctgttctttgtgatgctgaggttgctctcatcattttctctccaagaggaaagctttatgaatttgcaagctccagcatgcaggacacaattgaacgctaccgcaggcataacaggagtgctcaaacagtgaacagatctgatgaacaaaatatgcagcatttgaagcatgaaacagcaaacttgatgaagaagattgagcttcttgaggcttcaaaacggaagctcttgggagaaggtttggggtcatgctccttagaagaactgcaacagatagaacaacaattggaaaggagtgtaagcaatggtcgtgcaagaaagaatcaagtttacaagggacaaattgatcaactaaaagagaaggaaagagccctatatgctgaaaatgctaggctgtgtgagcagtatggtatccagccacagccagcaacaaaggatccgaaagaaattcaaccctatgcagaaagcagtccaagttcagaagtggagactgaattgttcattggactacccaggtctatctagttgaagataatttaatccttgcctagtatgaaataagaagcccaactgcaatgtataaatatcacatgtttcctaatactttgagatgaataatattatcgcttatattatataaagaactttccgattttatgattaaaaaagaaagaaaaaggactagtgcgctcgagtagctggtctaaccccggatcgattccggaccggta

SEQ ID NO: 2300 - protein, 209 aa, Glycine max
  G4064,MADS domain coordinates 2-57
MVRGKTQMRRIENATSRQVTFSKRRNGLLKKAFELSVLCDAEVALIIFSPRGKLYEFASSSMQDTIERYRRHNRSAQTVNRSDEQNMQHLKHETANLMKKIELLEASKRKLLGEGLGSCSLEELQQIEQQLERSVSNGRARKNQVYKGQIDQLKEKERALYAENARLCEQYGIQPQPATKDPKEIQPYAESSPSSEVETELFIGLPRSI

SEQ ID NO: 2301 - DNA, 1253 bp, Zea mays
  G4065,family:MADS
cgtgggcgccctcgccccccccccggagatccccgtccccgttttccacttttgcctccgccccaattcggataacaaacccctccgcctcgtcgcgtctcctcccagccgagccgatccggtagagagagggagagggagagggagggactgagggaggaggagctgggttccggtcccggccgcccggccggctgcgcgattcgattgtagctctcgtccccgggcggcgtccaggatggtgcggggcaagacgcagatgaagcgaatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtctgtctgtgtatcatcccgtcccgtccgtcagagtctcagagaacgaacacttcttctccttctccctgtagctagctgctcctgcttgtgtccagatcttctgttcgatcgggtttgggaccaaaaaaaaaaaaaaaaaagcggccaaaaaaaaaaaaaaaaaaaaaaaaaaaaaaaaaaa

SEQ ID NO: 2302 - protein, 232 aa, Zea mays
  G4065,MADS domain coordinates 2-57
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 2303 - DNA, 1117 bp, Oryza sativa (japonica cultivar-group)
  G4066,family:MADS
gggggaccaaaaaggaaagccgaggaggagagggaggggagagaagggagagggggtcggggagaaagaagagcgagcgagcagctttggctacggccaaaccctacagcgcctccaccaccactccttgccttttttggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaactgagagagaaggagatgaagctgcgcaaggacaatgaagagttacgcgaaaagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcg

SEQ ID NO: 2304 - protein, 230 aa, Oryza sativa (japonica cultivar-group)
  G4066,MADS domain coordinates 2-57
MVRGKTQMKRIENPTSRQVTFSKRRNGLLKKAFELSVLCDAEVALIVFSPRGKLYEFASASTQKTIERYRTYTKENIGNKTVQQDIEQVKADADGLAKKLEALETYKRKLLGEKLDECSIEELHSLEVKLERSLISIRGRKTKLLEEQVAKLREKEMKLRKDNEELREKCKNQPPLSAPLTVRAEDENPDRNINTTNDNMDVETELFIGLPGRSRSSGGAAEDSQAMPHS

SEQ ID NO: 2305 - DNA, 1724 bp, Oryza sativa (japonica cultivar-group)
  G4067,family:MADS
tggcgattgccggtctcggtcggtcgcactcgcgctcgcgcgcgggcgcctcgtgggtcgcgggtttcccaggacgggaagtcgctcgcgcggtcgccttctttatttggctaccgccgccccccggccccccgcattccgcacgaggctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggggggtagtttataagggcttgcgcgaggagggggaggagtagcgggtagcggcggctcgagtcgagtcgagtcgccgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaaacggaaacaaagaattaacaaagctgtagcagaccagatcggcaaattgaaatgccaggtaatccagtatatatttcgcttccgttattcagggtggtggtgattgggcctctgacgtgtgggtgcttgggacggaggatttcttgggggttgttttttccccgagccaaatcaatctgctcgtgcccttgagatttcagttccgcccataagaactcccacgcacatttagcattcggagagtaattttgttaggttaaaagtatggtaagttataggtggtatgttatgtttttctttttcttttctcaatgttatctggtacctaagtttgtcaagaaaatcatagtggacacagtcaagtatttggggc

SEQ ID NO: 2306 - protein, 233 aa, Oryza sativa (japonica cultivar-group)
  G4067,MADS domain coordinates 2-57
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGCSIEELRGLEMKLEKSLHNIRLKKTELLERQIAKLKEKERTLLKDNENLRGKHRNLEAAALVANHMTTTTAPAAWPRDVPMTSSTAGAADAMDVETDLYIGLPGTERSSNRSETG

SEQ ID NO: 2307 - DNA, 1405 bp, Solanum lycopersicum
  G4079,family:AP2
tttggctttatacctctaattatattgttctaattatatggtagaaagatctacttcccgccaaaaacaacaaagaaagtaatctctttttctttgttcactcatcaacttgtttctcaaatcatttgtatcactgcaactttttccacacttaaaaactttttatacaataatattggtcactattcactcacttcaaccagttcttgattgttttagtactcctttttgagcttatgatgatttttttttgtgctctttgaaaaaaatatcttttaaatcgaactgtaactttaagtttttggtataccatgacggaaaattcagttccggtgattaaattcactcaacacatagtaactacaaacaagcatgttttttctgagcataacgaaaaatccaattcagagttacaaagagttgtgaggattatacttacagatgccgatgctacagattcttccgatgatgaaggccggaatactgtacggagagtgaagaggcacgtgacggagatcaaccttatgccgtcaaccaaatcgatcggcgacagaaaacgaagatcggtgtctccggattctgacgtcactcgtcggaaaaagtttagaggcgttcgtcaaagaccgtggggtcgttgggctgcagagattcgggacccgacccggggaaaacgggtgtggttgggtacttatgacaccccagaagaagcagctgtcgtttacgataaagctgcagttaagctcaaaggtcctgacgccgttaccaattttccggtatcaacaacggcggaggtaacggtgacggttacggaaaccgaaaccgagtctgttgccgacggtggagataaaagcgaaaacgatgtcgctttgtcacccacctcagttctctgtgacaatgattttgcgccgtttgacaatctagggttctgcgaagtggatgcttttggtttcgacgttgattcacttttccggctgccggattttgctatgacggagaaatactacggcgatgaattcggcgaatttgactttgacgattttgcccttgaagctcgatagtgtacgaggggctatttcgtccatttttgcaaatgggttcactggttagttgactagtgacgtggcatttttggcgggaatatatatatagtgattagcagtctctattcatacgaagactttgtgagagatttttgtttttatttttctgttaattgtgggtgaatattgtaatatgaaaaattttgtatggtgaaattgaattaattaacgatgaagataaggagagtgaagggggatgtgtgtattttatgattgaggtgtgtttttgtgattctgaaaaaataatttattattttacgttggaaatataaagtcaaaattctattgaaaaaaaaaaaaaaaaa

SEQ ID NO: 2308 - protein, 248 aa, Solanum lycopersicum
  G4079,AP2 domain coordinates 95-157
MTENSVPVIKFTQHIVTTNKHVFSEHNEKSNSELQRVVRIILTDADATDSSDDEGRNTVRRVKRHVTEINLMPSTKSIGDRKRRSVSPDSDVTRRKKFRGVRQRPWGRWAAEIRDPTRGKRVWLGTYDTPEEAAVVYDKAAVKLKGPDAVTNFPVSTTAEVTVTVTETETESVADGGDKSENDVALSPTSVLCDNDFAPFDNLGFCEVDAFGFDVDSLFRLPDFAMTEKYYGDEFGEFDFDDFALEAR

SEQ ID NO: 2309 - DNA, 1147 bp, Nicotiana tabacum
  G4080,family:AP2
cggcacgagaaaatccccctataaattcattccctctttgtctcgaatattactctttttgctgctactaatttcatcttccaaccagttcttgatttctctttaatcttctacgtacaagattaatgttctaaatcctgttttctacaaaacatcaactttatcccatgataagaaatccagtcgtttctctaatggatgaaccaaaaacagttaagttttcccaacacatagtcactaaaaacaaacacgttcctgagcaaaacgaaaactccaatttccactctaagtttttacagagagttgttcgaatcatacttacagatgctgacgcaactgattcctcggacgacgaaggacaagatactgtacggagagtgaagaggcacgtgacggagatcaacctcatgccatcgcccaatttgatatgtgaaaagaaacgaagattggtttcgccggatactgacgtcactcgccggaaaaagtttaggggtgtacgtcaaaggccatggggtcgttgggcagcagagattcgggacccgacccggggaaaacgggtttggttgggaacctatgacaccccggaggaagcagctatcgtttacgacgcagctgctgttaagctcaaaggtcctgatgccgttactaactttccgaaagtattaacggcggatataacggaaatggagtctgttaccgaccgtggagagaaaagcgaaaacgacttcgctttgtcgccgacgtcagttctccgtaacgatgattttacgccgtctgacgatttggggttctgcgaagtggacgcttttgggtttgacgttgactcccttttccggttgccggaatttgggttgtcggagaaatactacggcgatgaattcggcgagtttgactttgacgactttgctctcgaagctcgatagtggggctatttggttgttttagatcaaagttgtggcatttttgtaacttgagtcattgctgatggtgacgtggcatttttgacgggactacacgtgattagtgccgatttatacggcgattttgcgagagatttgtaccttttttaatttaacatgtgatttgtgagggccaattgtgtagtaagaaaattttgtttttgttattccaaaaaaaaaaaaaaaaa

SEQ ID NO: 2310 - protein, 251 aa, Nicotiana tabacum
  G4080,AP2 domain coordinates 104-166
MIRNPVVSLMDEPKTVKFSQHIVTKNKHVPEQNENSNFHSKFLQRVVRIILTDADATDSSDDEGQDTVRRVKRHVTEINLMPSPNLICEKKRRLVSPDTDVTRRKKFRGVRQRPWGRWAAEIRDPTRGKRVWLGTYDTPEEAAIVYDAAAVKLKGPDAVTNFPKVLTADITEMESVTDRGEKSENDFALSPTSVLRNDDFTPSDDLGFCEVDAFGFDVDSLFRLPEFGLSEKYYGDEFGEFDFDDFALEAR

SEQ ID NO: 2311 - DNA, 803 bp, Arabidopsis thaliana
  G41,family:AP2
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 2312 - protein, 207 aa, Arabidopsis thaliana
  G41,AP2 domain coordinates 39-106
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 2313 - DNA, 654 bp, Arabidopsis thaliana
  G412,family:HB
atgaactacacggtggatgatcagaacatggcttttatctctcaactgtaccctgatgtctacactcagatagtacaaccagtaggagaagtgaagcagccgaagcggaggaggaagaagaccaaaggatccgtggcttccgcagatggaggcaacggtttgtttagaaagaggaagctgaccgatgaacaagtgaacatgttggagatgagttttggggatgaacacaaacttgagtcggagaggaaagatagacttgcggcagagctagggcttgaccctcgtcaagttgccgtttggtttcagaaccgtcgcgcacggtggaagaacaaaaggctcgaggaagagtacaataaactcaagaactcacatgataacgtcgttgtcgacaagtgccgacttgaatctgaggttattcagctcaaagaacaactctatgatgcagagagggaaatccaaagattagcagaaagagtagaaggaggctcaagcaacagtccaatttcgtcttccgtttccgtcgaagctaatgaaacgccattttttggagactataaagtcggagatgatggcgatgactatgatcacttgttttatccggtgccggaaaatagttacatcgatgaagcggaatggatgagtctatacatataa

SEQ ID NO: 2314 - protein, 217 aa, Arabidopsis thaliana
  G412,HB domain coordinates 59-112
MNYTVDDQNMAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 2315 - DNA, 850 bp, Arabidopsis thaliana
  G42,family:AP2
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatct

SEQ ID NO: 2316 - protein, 216 aa, Arabidopsis thaliana
  G42,AP2 domain coordinates 48-109
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 2317 - DNA, 951 bp, Glycine max
  G4218,family:MYB-(R1)R2R3
ccacgcggcccgctctctccacacacatatataaacccaaacaagtgaacaacactccctcctttgtcccattactagtacatacattcccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatcagcttagccccgccgtggagcaccgccccttctcggcccaagaggacgacaccatcatcgcggcccatgcccagtatggtaacaggtgggccactatagcccgattgctaccgggccgaaccgataacgccgttaagaaccactggaactccactctcaagcgcagagccaaaggtattaacattaatgttaatcacgccaacaacgaagtggctgcttcttcttccgctccttctcgccacttcgacttcgaggatgatccgttgaccgcgttgactctcgctcctcctggtattgctaatggcactgtggcggaggacgccgtgccggaccatcgtgcctcgccggaggggttttgggatatgatgagggatgtgatcgcgagggaagtgagggaatatgtgtcttccaatttttctgataactcgggttttcattaaatcaatcataatcataattgttattatgcttcttcttttttctttttttttttttaactttaggcaaattattctgcaatttgattttgccttactggactttggaatcggatcagagaattaaattaaattagacccttctgaaaaaaaaaaaaaaaaaaaag

SEQ ID NO: 2318 - protein, 221 aa, Glycine max
  G4218,MYB-(R1)R2R3 domain coordinates 31-131
MEATNRSSSSTSSSSDCCSSESNPNKPDRIKGPWSAEEDRILTGLVERYGPRNWSLISRYIKGRSGKSCRLRWCNQLSPAVEHRPFSAQEDDTIIAAHAQYGNRWATIARLLPGRTDNAVKNHWNSTLKRRAKGININVNHANNEVAASSSAPSRHFDFEDDPLTALTLAPPGIANGTVAEDAVPDHRASPEGFWDMMRDVIAREVREYVSSNFSDNSGFH

SEQ ID NO: 2319 - DNA, 928 bp, Glycine max
  G4219,family:MYB-(R1)R2R3
ggaattcgtttacgcccgactatacataaacccagtttcctggaagtaccccctgtctctaatctcattcatgccattaattataattataaacccaaacaagtgaacaaccctctctcctggggcccattccccctaaccaagtttaagtttctagattggtagaaatgaacagaagctcctcctccacttcctcttcctctcactgttgctctttagagtccaaccataggagccccaacaagccagacagaatcaaaggcccatggagcgcccaagaggatcggatcctgacacgactagtcgaacaatacggccctcgaaactggtccctcatcagccgctacattaagggcaggtccggcaaatcgtgccggctgcggtggtgcaatcagctgagccccaccgtggagcaccgccccttctcgacccaagaggacgagaccatcatcgctgcccatgcccggtacggtaacaggtgggccaccatagcccgattattaccgggccgaaccgataacgccgttaagaaccactggaactccacgctcaagcgcagagccaagggtattaacgttaatgttaatgatgccgacaacgaggatgacccgttgaccgcattgactcttgctcctcccggtattgctaatgccactttgaccgaagacgccgtaccggaccaccgggcctcgccggagagtgcggcggaggggttttgggatatgatgaagggatgtgatccgcgagggaggtgaggggatatgtgtcttctaatttttctgataataactagggttttcattaaatcaatcatcataagcataatttgttattatgtcttccttttttttttaggcaaattattctgcaatttgattttgccttactggactttggaatcggatcagggaaataaattaaaaccctt

SEQ ID NO: 2320 - protein, 195 aa, Glycine max
  G4219,MYB-(R1)R2R3 domain coordinates 31-131
MNRSSSSTSSSSHCCSLESNHRSPNKPDRIKGPWSAQEDRILTRLVEQYGPRNWSLISRYIKGRSGKSCRLRWCNQLSPTVEHRPFSTQEDETIIAAHARYGNRWATIARLLPGRTDNAVKNHWNSTLKRRAKGINVNVNDADNEDDPLTALTLAPPGIANATLTEDAVPDHRASPESAAEGFWDMMKGCDPRGR

SEQ ID NO: 2321 - DNA, 987 bp, Glycine max
  G4220,family:MYB-(R1)R2R3
tcacttcttcttcttcctcctcctccctctctcacaatttttattttttaatgatactattttgttattgttattgatggtatcatcatcgggaaaaagcagagaaatggatagggtgaagggtccatggagcccagaagaggacgaggccctgcgggcgctggttcaggcccacgggcctcgaaactggtcggtgataagcaagtccattccggggagatccgggaaatcgtgccgcttacggtggtgcaaccagctctcgccgcaggtggcccatcgccccttctcgcaggaggaggacgaggccatcatcatggcccacgccaagttcggcaacaagtgggccaccatagctcgcctgctcaacggccgcaccgataacgccgtcaaaaaccactggaattccactctcaagagaaaatcctccgccgttagtgacgacgacgtcgtcacgcatcgtcagcctcttaaaagatccaacagcgtcggcccggcccacttgaaccctgccagcccatcagtctccgatttgagcgatccgggccttcccgctctgtcaaacccctcaccttcggcccattacatgcccaatctcatggaaactgcttcttccgctcccgatccagccacgtcacttagtttgtctctccctgggttcactgtacctcaaccagtgtctccgccgccgccgccactgccactgccggcggagacggtggaggagcgagggaagcaaatgttcaacgcggagttcttgagagtgatgcaagagatgataaaaaaggaagtgaggagttacatgtcagggatggaagaacagaagaatgggttcagaatgcaaaccgaagcgattgggaacgcggtggtgaagcgcatgggaattagcaacatcgagtgaagaaaaagaaaacggtgtcgtttcgagattcgaatcaagccaactggcacatgaatgatgatgaatcacaagagtaggagaaaagtgag

SEQ ID NO: 2322 - protein, 273 aa, Glycine max
  G4220,MYB-(R1)R2R3 domain coordinates 15-115
MVSSSGKSREMDRVKGPWSPEEDEALRALVQAHGPRNWSVISKSIPGRSGKSCRLRWCNQLSPQVAHRPFSQEEDEAIIMAHAKFGNKWATIARLLNGRTDNAVKNHWNSTLKRKSSAVSDDDVVTHRQPLKRSNSVGPAHLNPASPSVSDLSDPGLPALSNPSPSAHYMPNLMETASSAPDPATSLSLSLPGFTVPQPVSPPPPPLPLPAETVEERGKQMFNAEFLRVMQEMIKKEVRSYMSGMEEQKNGFRMQTEAIGNAVVKRMGISNIE

SEQ ID NO: 2323 - DNA, 845 bp, Glycine max
  G4221,family:MYB-(R1)R2R3
tattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcaggtggcccaccgccccttctcgccggacgaggacgaggccatcgtcagggctcacgccaggttcggcaacaagtgggccaccatagctcgccttctcaacaacggccgcaccgataacgccgtcaaaaaccactggaactccactctcaagagaaaaaaatgttccgccgttagtgacgacgtcaccgatcgtccgcctcttaaaagatctgcaagcgtcggcccggcccatttgaaccctggcagcccatcgggctccgatttgagcgatccgagcctgcccgctctctcaaacccctccccctcggcccattacaggcccaatctcatggaaaccgcttcttctgcttgcgatccagccacgtcactgagtttgtctctccccgggttcgggtccgggtctaacccagtttgcgcacctcgaccggtatcggtgtctccgccgtcaccgcctccggcggagccggtggagcagcgggggaagcaaatgttcaacgcggagttcttgagagtgatgcaagagatgataagaaaggaagtgaggagttacatgtcagggatggaacagaagaatggcttcagaataccaaccgaagcgattgggaacgcggtggtgaagcgcatgggaattagcaacatcgagtgaaggaaagaaac

SEQ ID NO: 2324 - protein, 268 aa, Glycine max
  G4221,MYB-(R1)R2R3 domain coordinates 5-106
MDRVKGPWSPEEDEALRRLVQAHGPRNWSVISKSVPGRSGKSCRLRWCNQLSPQVAHRPFSPDEDEAIVRAHARFGNKWATIARLLNNGRTDNAVKNHWNSTLKRKKCSAVSDDVTDRPPLKRSASVGPAHLNPGSPSGSDLSDPSLPALSNPSPSAHYRPNLMETASSACDPATSLSLSLPGFGSGSNPVCAPRPVSVSPPSPPPAEPVEQRGKQMFNAEFLRVMQEMIRKEVRSYMSGMEQKNGFRIPTEAIGNAVVKRMGISNIE

SEQ ID NO: 2325 - DNA, 983 bp, Glycine max
  G4222,family:MYB-(R1)R2R3
ctttaaccttaccagctcgagataagacatggaccggatcaaaggcccatggagtccggaggaggacgaggctctgcagaagctggtggagaaacacgggcccaggaactggtctctgatcagcaagtccatcccgggccggtccggcaagtcctgcaggctccggtggtgcaaccagctgtccccccaggtggagcaccgggccttcacggccgaagaggacgacaccataatccgggcccatgcccgcttcggcaacaagtgggccaccatagcccgcctcctccacggcagaaccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatccgatgtgagcgagtccagcttaccggttgcatcctcttcgcacgtgttccgtcccgtgcctagaactgtcaaggttctaccacccgtagaaaccacgtcgtcctccaatgaccctccaacttcactttctctatcactccccggtgttggtgttgttgactcatccgaagtctccaatcggacaactgagccgattcattttacaccgccaatgccacatcggtcgaatactatgcctttgctgccaatgatgacgtcggtttcagcgacggtgatggcgccgtttaattttagcgcagagtttcggtcggtgatgcaggaaatgataaggaaggaggtgaggagttatatagagttgcacaatcagaatgggatgtgttttcaggctgcggtgaatgatgggtttaggaacgcttccgtcaagcgtattggaattagcagggttgattcgtaaatagtatcatcggagaaaagaatgttcatttgctcctcctaatgggaaaaaaataagaaga

SEQ ID NO: 2326 - protein, 297 aa, Glycine max
  G4222,MYB-(R1)R2R3 domain coordinates 5-105
MDRIKGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRKCSSTMIDDNTQPLKRSVSAGAAIPVSTGLYMNPPTPGSPSGSDVSESSLPVASSSHVFRPVPRTVKVLPPVETTSSSNDPPTSLSLSLPGVGVVDSSEVSNRTTEPIHFTPPMPHRSNTMPLLPMMTSVSATVMAPFNFSAEFRSVMQEMIRKEVRSYIELHNQNGMCFQAAVNDGFRNASVKRIGISRVDS

SEQ ID NO: 2327 - DNA, 1209 bp, Glycine max
  G4223,family:MYB-(R1)R2R3
ttccatttcctctcacaaaaatcacttattatgaacacacgaaaagacatggaccggatcaaaggcccatggagcccggaggaggacgaggctctgcagaagctggtggagaaacacgggcccaggaactggtccctcatcagcaagtccatcccgggccgctccggcaagtcctgcaggctccgctggtgcaaccagctgtccccccaggtggagcaccgggccttcacccacgaagaggacgacaccattatccgggcccatgcccgcttcggcaacaagtgggccaccatagcccgcctcctccacggcagaactgacaacgccatcaaaaaccactggaactccaccttgaagcgcaagtgcacttcaaccatgattgacgacgacaacactcccccgctcaaaagatccctcagtgccggcgctgctattccagtctccactggactctacatgaaccctcccactcctggtagcccctctggatcagatgtgagtgagtccagcgtactggttgcatcctcctcacatgttttccgacccgtgcctagaacaggcgcggttctaccacccgtagaaacaacaacgactttgtcttccaatgaccctccaacttcactttccctatccctccccggtgttgactcatccgaagtttccaatcgaacaactgagccgattcatgccgcacctcctccgccgccacagccacagccacagccgttgaatactatccctttgctcccaatgatgacggtgccctcggtttctccgacggggatggcgccgtttaattttagcgcagagtttctggcggtgatgcaggaaatgataaggaaggaggtgaggagttatatggagttgcacaatcagaagaatgggatgtgttttcaggctgcggtgaatgatgggtttaggaacgcttcggtgaagcgtattggaattagcagggttgattcgtaaatattatcatcgaagaatggaacaacacaagtagagatgaggaaaaaaactaagaacctgtttttttccctgtttttttttaatcaatgttcttaggcaataattttggttgatgtacagcgagacagaactctcgatccctaaagaggctgaatggaaattggaacgaaagagggagatagatgttacccattagataaaatctgaaatctctgttgtaactttttgtatcctcgcggccgc

SEQ ID NO: 2328 - protein, 311 aa, Glycine max
  G4223,MYB-(R1)R2R3 domain coordinates 11-111
MNTRKDMDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 2329 - DNA, 1061 bp, Glycine max
  G4224,family:MYB-(R1)R2R3
attcggctcggctgcttcggcaaaggacatggatcggataaaagggccatggagtcctgaagaggacgaagcgttacggaggttggttcagacttacggccctaggaactggtccgttataagcaaatccattccgggtcggtctgggaaatcgtgccgcttgcggtggtgcaaccagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgttattgagtttgtctctaccgggattcgattcgtgcgatggggctaataatgggcctgggccgaatcaggggcccagttgcggcccgttccaggagataccgatgcttggttcccaaaagcagttgttcagccaagagtttatgaaggtgatgcaagagatgatacgagtggaagtgagaaattacatgtctgtactggaacgtaatggtgtgtgtatgcaaaccgatgccattaggaactcggtgttggagaggatgggaattggtagggttgaataatgaattcaagagcggaaaattatattcatattaggtcatggaaaaatgattaggtgaaatcgcagagaaatagtgattctatctttttattttttgttaggttaattatcctttttttaaatgataattattttttatctgtgccgaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2330 - protein, 259 aa, Glycine max
  G4224,MYB-(R1)R2R3 domain coordinates 5-105
MDRIKGPWSPEEDEALRRLVQTYGPRNWSVISKSIPGRSGKSCRLRWCNQLSPEVERRPFTAEEDEAILKAHARFGNKWATIARFLNGRTDNAIKNHWNSTLKRKCSEPLSEPRPLKRSATVSGSQSGSDLSDSGLPIILARSVSVTVAPSNHLAETASSSVTDPATLLSLSLPGFDSCDGANNGPGPNQGPSCGPFQEIPMLGSQKQLFSQEFMKVMQEMIRVEVRNYMSVLERNGVCMQTDAIRNSVLERMGIGRVE

SEQ ID NO: 2331 - DNA, 939 bp, Glycine max
  G4225,family:MYB-(R1)R2R3
caaaccccaaaaaaagaaaagatgaaagcaatgaaacgctgctcttcatcatcttcctcttcttattcttctgcttctgagtccaccccacaaagcaatcaaaataaaaatagtaataacttttgctacaaaataaaaggcccatggagtgccaaggaggatcggattctgaccggcctcgtggaggcccatggcccgagaaactgggcctcgataagccgtcacattaagggtcggtccgggaagtcctgccggcttcggtggtgtaaccaactgagtccaacggtggagcaccgacctttctccacgcgcgaggacgaggttatattacacgcgcacgcgcggttcgggaacaagtgggccaccatcgcgagaatgctaccgggccgaaccgacaatgccgtcaagaaccactggaacgccacgctcaagcggcgtcgttttggtgctgacgtggtggtggaggatgatccgttgaccgcgttgactctggcgccgcccgggagtggttgttgtggccgtggagaggagcggcggggagtttcgccggcggggttttgggatgcgatgcgggacgtggtggcgagggaagtgagagggcacgtgtcttcctcgttttctgacaacttggcctctaatgagggattatccaaatattaatgtttttttttcatgatttattaagggaatttatgtggtttagttattattggacttcaggacccataaggggaacagttcagtgtaaaatttgtattattgattaattaaaaatcaatttaaatatcatactactatttcatatgtaattattataaattttaattatgtaataattgattattaagtgatattataaatattagtatatgtaaatttttttagcgaatggtatatgtaaatatttaaatcaacttatcctaatcatttcgtttgatt

SEQ ID NO: 2332 - protein, 212 aa, Glycine max
  G4225,MYB-(R1)R2R3 domain coordinates 39-139
MKAMKRCSSSSSSSYSSASESTPQSNQNKNSNNFCYKIKGPWSAKEDRILTGLVEAHGPRNWASISRHIKGRSGKSCRLRWCNQLSPTVEHRPFSTREDEVILHAHARFGNKWATIARMLPGRTDNAVKNHWNATLKRRRFGADVVVEDDPLTALTLAPPGSGCCGRGEERRGVSPAGFWDAMRDVVAREVRGHVSSSFSDNLASNEGLSKY

SEQ ID NO: 2333 - DNA, 1340 bp, Zea mays
  G4226,family:MYB-(R1)R2R3
aattcggcacgcgggacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccggctgcggtggtgcaaccagctgtcgccgcaggtggagcgccgccccttcacgcccgaggaggacgccgcgatcctggccgcgcacgcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggggctggaccagtcgccgtcgggcttccaccacgacagcgcccggagccacttccaggagctctccccctcgtcgtccccgtcgccgcagtctactccacccgccttccctccgcaggcggctccgtctcagtcgtcgtacgcgttcagcggcgagctggttgccgcgatgcaggagatgatccgcgccgaggtgcgcaagtacatgtccggcgcggggctccgcgccggatgcgggcccggggccgtgggcgaggtgtgcatgccgcagctggtggagggtgtgatgcgcgcccccgcggagcgcgtcggcgtcgtcacacggccgtagaaacccggaaacggaccaaatcagatctgatcaatgcgaagcattgtgttaattaagatcccgtccgtcctgtgtagcagcgctacgtagactactactactactagtcgttctctggccgttgtatttagcagaggagctcgcgtttgtttattcttcggcggctgtcgctctgaatccagaaaggaacagagcggcggtgtaaagccgggagcggaagcggaggttggcaataatcgagatcgagcctgccatttctataaccggatgtggccgcggcttgctccaaaaaaaaaaaaaaaaaaaaaaaaaaaaaaaaaaaaaaaaaaaa

SEQ ID NO: 2334 - protein, 304 aa, Zea mays
  G4226,MYB-(R1)R2R3 domain coordinates 11-111
MGVESECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRKLATATATSSGSDAERACKRASPGPGSPTASDRSDLSHGCGAAQVFRPVPRAGGFDAISAADVRPPPPPAVADEDPLTSLSLSLPGLDQSPSGFHHDSARSHFQELSPSSSPSPQSTPPAFPPQAAPSQSSYAFSGELVAAMQEMIRAEVRKYMSGAGLRAGCGPGAVGEVCMPQLVEGVMRAPAERVGVVTRP

SEQ ID NO: 2335 - DNA, 1018 bp, Zea mays
  G4227,family:MYB-(R1)R2R3
ttgggtaccccctcgaggggccggcccgggccgggggcccgggggccgtgcagagtgcaggtgaagatgatgaagaactaccctggtcctgctagcagcagtagtgttgctgtagaggtgaagaaggggtcatggagccccgaggaggacgccctgctgaccaggctggtggagcagcacgggccccaccgctggagcctcatcagcgccccaatccctggccgctccggcaagtcctgccgactccgctggtgcaaccagctcagccccgacgtgcaccaccgccctttcacgccgcacgaggacgcgctcatcctcgccgctcacgcccgctacggcaacaagtgggccaccatcgcgcgcctccttcccggccgcaccgacaactccatcaagaaccactggaactccaacctccggaggtgcaggcgccgagcggcggcggcggcggtggcctcccgaccgcaggtgcaggacagcgacgacgctcctgctgctgctgctgctcatgatgatcagccggcggctgtggttgctgctggtggtttaggtggtggcaacagcagcagcggtctgccgcctgcagcagcaggggccgcaactgccgaggccgagccgtctctgtccctcagccttggcctcccgctgccagcagcagaaccagctgaagccgcggctgacgacgagagccgcaacagccagggccaggcatcgccgttactggaggaaggagaaggaaacgcgcagctgttggcagtggtgcgccggatggtcagggaggaggtgcaacgccagacgggacagctcgcctactcgctcatggccgcagcagcagccagagccaagggacaccaccgttaatctgtgtgtgatccattgtgcatgctgctgctgctgctgcttcttggatttcccctcctttctccgatatgatcctctctgccaagtgtattttgttttccttcgtttcttgtactaccttcccttgtgttcgtttatgcgattgcgattggacttc

SEQ ID NO: 2336 - protein, 264 aa, Zea mays
  G4227,MYB-(R1)R2R3 domain coordinates 20-120
MMKNYPGPASSSSVAVEVKKGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRCRRRAAAAAVASRPQVQDSDDAPAAAAAHDDQPAAVVAAGGLGGGNSSSGLPPAAAGAATAEAEPSLSLSLGLPLPAAEPAEAAADDESRNSQGQASPLLEEGEGNAQLLAVVRRMVREEVQRQTGQLAYSLMAAAAARAKGHHR

SEQ ID NO: 2337 - DNA, 1105 bp, Zea mays
  G4228,family:MYB-(R1)R2R3
ggccacgcgccccaatactcagaactagtcttgagtaaagcatggcgtcgtcttctccgtcctgccgtggcagcggcggcaagtcggacgtggaccggatcaagggcccctggagccccgaggaggacgaggccctgcagcgcctggtggcccgccacggcgcccgcaactggtccctcatcagccggtccatcccgggccgctccggcaagtcgtgccgcctccggtggtgcaaccagctgtcgccgcaggtggagcaccggcccttcacggccgaggaggacgacaccatcctccgcgcgcacgccaggttcggcaacaagtgggccaccatcgcgcgcctcctctccggccgcaccgacaacgccatcaagaaccactggaactccacgctaaagcgcaagtactacgccgccagcgacgctgttgttgctgacgctgacgacgagcgcccgctgaagcgcacaagcagcgacggccacccagggctctgcttcagccccggaagcccatccgggtccgacctcagcgactctagcaaccacagccttccctccgtcatgccgtcagccgcttctgctgccgccgtcacctcccaccagcagcagcagcacgtgtaccgccccgtgccgcgcgcgggcggcgtggtcatgctaccggtggcgcctcttgcgccgccgccgccgccacagcctccggcgacctccttatcactgtccctctccctgcccgggctggacggccagaagcccgaagcatcccaagcggttctgacgccggcaccggcaccgcctcaacctcctcttcagatacagcagcagcagcctgctccacctcagatgccgccaccacaagcccaaccgagcttgccgttccagctgcaggcggccgcgacgaacctcacgtcgcagcagccggcagcagcgccgttcagctcggagttcctgttgttgatgcaggagatgatccggatcgaggtacggaactacatgtccgggtcggggctcgatccgcgcaccgacggcgccgccgtgcacgccgtgagcaagcgtatgatgggtatggccaagatcgagtagtttcagcgcgcatgcacacagcggca

SEQ ID NO: 2338 - protein, 345 aa, Zea mays
  G4228,MYB-(R1)R2R3 domain coordinates 21-121
MASSSPSCRGSGGKSDVDRIKGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRKYYAASDAVVADADDERPLKRTSSDGHPGLCFSPGSPSGSDLSDSSNHSLPSVMPSAASAAAVTSHQQQQHVYRPVPRAGGVVMLPVAPLAPPPPPQPPATSLSLSLSLPGLDGQKPEASQAVLTPAPAPPQPPLQIQQQQPAPPQMPPPQAQPSLPFQLQAAATNLTSQQPAAAPFSSEFLLLMQEMIRIEVRNYMSGSGLDPRTDGAAVHAVSKRMMGMAKIE

SEQ ID NO: 2339 - DNA, 1036 bp, Zea mays
  G4229,family:MYB-(R1)R2R3
cattgggtacctcgaggccggccgggaaccttcactcccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcagcccgaaccatccccgccgccgccgccaacacctcaagcacaagcaagctcgccgttgagcgcggagttcctgttgatgatgcaggagatgatccggatcgaggtccggaactacatgtccgggtcgggcttcgacgcacacgccgtgatgggcatggccgagatcgactagtttcagcggcaggggtcc

SEQ ID NO: 2340 - protein, 285 aa, Zea mays
  G4229,MYB-(R1)R2R3 domain coordinates 21-121
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRERERKREYYADARPGPGDQRSLKRTSSDGPPGSPSGSDLSDSSHQSLPTVMPSAASTAVTSQQQLQHVYYRPVPRAGGVVLLPVAPPSPQAPPATSLSLSLSLPGLDQQPEPSPPPPPTPQAQASSPLSAEFLLMMQEMIRIEVRNYMSGSGFDAHAVMGMAEID

SEQ ID NO: 2341 - DNA, 1339 bp, Zea mays
  G4230,family:MYB-(R1)R2R3
tcctccaccactgccccgtcgtggaataggggcaagttcaggcatctcgcttctgtcctggtcgaggggatcggagaaaaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttc

SEQ ID NO: 2342 - protein, 302 aa, Zea mays
  G4230,MYB-(R1)R2R3 domain coordinates 11-111
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 2343 - DNA, 1402 bp, Zea mays
  G4231,family:MYB-(R1)R2R3
attgctctccaaccaacctccgccctctcctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtcccgggccggtcgggcaagtcgtgccgcctgcggtggtgcaaccagctcggacgcgggggggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcggcgccgccgccgccgcgtccggttcggcggtttccgctgacgactccgccgccgccgccgagaccgaggcgcgccggggcaagatgatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaggaggaggacccgctcaccgccctcagcctctcgcttcccggcacggaccagcggtttcaccaccacagcgccgccgccgacagccacttccaggagctcccgccgtcgccctcctcacccgcgccctcggcctacccgttcagccccgagttcgcggcggcgatgcagcagctgatccgcaccgaggtgcagcggtacatggcgagcgcgggcctgcgcgccggctgcggcgccgttggcgcgaccgacctctgcatgccgcagctggtggacggcgtcatgcgcgctgccgccgaacaggtcggccggatgcagtagccccgcgcccccggcgggggcatcaaaccgtcagtgctcccaaatcgtcgtctagctagggcgaccgcaacgcaacggttgttggagtagcaaacttggttttaaggtggagggaaaaattggctgggctgaaagcagaaagccttgtaatgtacatgaaagaaacggaacggatggcgcgctacaatctgagctcgccattgccgcatatatctgctttaagagagcattgcgctgccttgcct

SEQ ID NO: 2344 - protein, 308 aa, Zea mays
  G4231,MYB-(R1)R2R3 domain coordinates 12-112
MGAEAAERDRIRGPWSPEEDEALRRLVERHGARNWTAIGRGVPGRSGKSCRLRWCNQLGRGGARRPFTADEDAAIARAHARLGNRWAAIARLLPGRTDNAVKNHWNCSLKRKLGAAAAASGSAVSADDSAAAAETEARRGKMMMMSISPPDSPSGSGSGSDRSDLSSHGAGSGSGSGSGQIYRPVAARSGGFEPADCAMSRPQEEDPLTALSLSLPGTDQRFHHHSAAADSHFQELPPSPSSPAPSAYPFSPEFAAAMQQLIRTEVQRYMASAGLRAGCGAVGATDLCMPQLVDGVMRAAAEQVGRMQ

SEQ ID NO: 2345 - DNA, 927 bp, Zea mays
  G4232,family:MYB-(R1)R2R3
gtacctcgaggccggccgggaaccaaactcctggtcttctcttctccactacccacccgcccgcccgcccgccttctcctccaccactgccccgccgctaaccaaccactctgtgcgccacaagtctcccgtcgtggaatagggcaaaggccaggcatctcgcttctgtcctctgtcgaggggatcggacccgatcggagaaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccccctgcggtggtgcaaccagctgtcgccgcaggtggagcgcccccccttcacgcccgaggaggacgccgcgatcctggccgcgcacgcccggctgggcaaccggtgggccgccatcgcgcgccttctcccggggcgcaccgacaacgccgttaagaaccacgacagcgcccggagccacttccaggagctctccccctcgtcgtccccgtcgccgcagtctactccacccgccttccctccgcaggcggctccgtctcagtcgtcgtacgcgttcagcggcgagctggttgccgcgatgcaggagatgatccgcgccgaggtgcgcaagtacatgtccggcgcggggctccgcgccggatgcgggcccggggccgtgggcgaggtgtgcatgccgcagctggtggagggtgtgatgcgcgccgccgcggagcgcgtcggcgtcgtcacacggccgtagaaacccggaaacggaccaaatcagatctgatcaatgcgaagcattgtgttaaaaaaaaaaaaaaaaaaaaaaaaaaaaaaaaaaaaaaaaaaaaaaaaaaaaaaaaaaaaaaaaaa

SEQ ID NO: 2346 - protein, 201 aa, Zea mays
  G4232,MYB-(R1)R2R3 domain coordinates 11-103
MGSEADCDRIRGPWSPEEDDALRRLVERHGARNWTAIGREIPGRSGKSCPLRWCNQLSPQVERPPFTPEEDAAILAAHARLGNRWAAIARLLPGRTDNAVKNHDSARSHFQELSPSSSPSPQSTPPAFPPQAAPSQSSYAFSGELVAAMQEMIRAEVRKYMSGAGLRAGCGPGAVGEVCMPQLVEGVMRAAAERVGVVTRP

SEQ ID NO: 2347 - DNA, 1008 bp, Oryza sativa (japonica cultivar-group)
  G4234,family:MYB-(R1)R2R3
gaggagattgatcggtgagggaggatgatggcgtcttgtcggagaggagggggaggggatgtggataggataaaggggccgtggagtccggaggaggacgaggcgctgcagcggctggtggggcggcacggggcgcgcaactggtcgctgataagcaagtccatcccggggaggtcggggaagtcgtgccggctgcggtggtgcaaccagctgtcgccgcaggtggagcaccggcccttcactcccgaggaggacgacaccatcctccgcgcccacgcccgcttcggcaacaagtgggccaccatcgccaggctcctcgccggccgcaccgacaacgccatcaagaaccactggaactccaccctcaagcgcaagcaccactcttctctcctcgccgacgacctccgccctctcaagcggacaaccagcgacggccacccgacgctctcctccgccgccgcccccgggagcccctccggctccgacctcagcgactccagccaccatagcctcccctcccagatgccctcctcacccccacacctcctcctccctcagcacgtctaccgcccggtcgcgagggccggcggggtcgtcgtccctcctcctcctcccccgccgcctccggcgacctcgctctccctctctctctcccttcccggcctggatcacccacaccccgatccctccaccccgtcggagcctgcggtacagttgcagccgcctccaccgtctcagatgccgccaccaacaccatcttgtgtacgccaagagccgcctcagatgccgttccagctgcagcccccaccgccgccgcgcccatcggcgccgttcagcgcggagttcttggccatgatgcaggagatgatccggatcgaggtccggaattacatgtccggctccgccgccgtggatcctcggtcgtcgcccgacaacggcgtgcgcgccgccagccgcatcatgggcatggccaagatcgagtaatcaaccagccgcagcagcatacgg

SEQ ID NO: 2348 - protein, 319 aa, Oryza sativa (japonica cultivar-group)
  G4234,MYB-(R1)R2R3 domain coordinates 17-117
MMASCRRGGGGDVDRIKGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRKHHSSLLADDLRPLKRTTSDGHPTLSSAAAPGSPSGSDLSDSSHHSLPSQMPSSPPHLLLPQHVYRPVARAGGVVVPPPPPPPPPATSLSLSLSLPGLDHPHPDPSTPSEPAVQLQPPPPSQMPPPTPSCVRQEPPQMPFQLQPPPPPRPSAPFSAEFLAMMQEMIRIEVRNYMSGSAAVDPRSSPDNGVRAASRIMGMAKIE

SEQ ID NO: 2349 - DNA, 1369 bp, Oryza sativa (japonica cultivar-group)
  G4235,family:MYB-(R1)R2R3
gaacccccatcgccaccaccaccaccaccactcgcgaactagacagaaaccgcaagaaaccaaacaccttttggctcctccactagtagcaactactcgttgtcgtcgtcgtcgtcgactcgtcgtggtagtagtagtcttcttcgcgtgacgccatgggaggaggaggaggagttgaggcggattgcgacaggatcagggggccgtggagccccgaggaggacgaggcgctgcggcggctggtggagcggcacggcgcgaggaactggacggcgatcgggcgggagatccccgggaggtcggggaagtcgtgccggctgcggtggtgcaaccagctctcgccgcaggtggagcggcggccgttcaccgccgaggaggacgccaccatcctccgcgcacacgcgcggctcgggaacaggtgggccgccatcgcgcgcctcctccagggccgcaccgacaacgccgtgaagaaccactggaactgctccctcaagcgcaagctcgccgtcgccaccaccaccaccaccaccaccaccggcgccgccgccgcgccgggagtggtcgccgatgccgccgagctcgtcgagcggccgtgcaagcggttcagccccacgccggacagcccgtcggggtctggttccgggtcggaccgcagcgacctcagccacggcggcgggttcgggcagattttccggccggtggcgaggaccggcgcgttcgagcccgtcgactgcgccatcagccggcggcaggaggaggatcccttcacctcgctctccctctcgctccctgggacggatcagcggttcaaccacgacagcgcccacagccacttccaagaactcccgtcctccccctcgccgccaccaccacctccccccgccgccgccgcctcgacgacacagtacccgttcaccccggagttcgccgccgcgatgcaggagatgatccgcgccgaggtgcacaagtacatggcgagcgtcggcgtccgcgccgggtgcggcgacgccggcggtgccgacctccacatgccgcagctggtggagggcgtcatgcgcgccgccgcggagcgcgtcgggaggatgcactgatcaaaaacctagcgtccattagaatctctactatcgtttcaactttttttttccttaaaaatttgtttccaaaactgctgtgaaaaccgaaacagcagtccgaaacggaagaaccaaaaaaaaatgcgaggagagatgggaaagaaatgtttcgagctacgaaaaaaaaccgaaaagctcggctacctatgtacaggaaatggaaatggaaatgcaaatgggggaagtgagtggtgaatcatgcaaaaaaaaaaaaatcagaattcaccatttttgct

SEQ ID NO: 2350 - protein, 311 aa, Oryza sativa (japonica cultivar-group)
  G4235,MYB-(R1)R2R3 domain coordinates 15-115
MGGGGGVEADCDRIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 2351 - DNA, 912 bp, Oryza sativa (japonica cultivar-group)
  G4236,family:MYB-(R1)R2R3
atgctgattcacggggagggctcgtcgtcgtcggcggcggcggcgggggggaagatcaaggggtcgtggagcccggaggaggacgagcagctgagaggggcggtggcgaggcacgggccgaggaactggacggcgatcagcgaggaggtgcccgggaggtcggggaagtcgtgccggctgcggtggtgcaaccagctcagccccggggtgcaccgccgccccttcacccccgacgaggacgcgctcatcgtcgccgcccacgccaagtacggcaacaagtgggccaccatcgcgcgcctcctcgacggccgcaccgacaactccgtcaagaaccactggaactcctcgctccgccgcaaccgcagggccgccgccgcggccgccgcggcggctgcatccgtgtcgtaccagtccatggatctcaccgaggaggccgacaacgacgacgagggcaccagcgacgactcggtggcgatccctgcgcagtcgtcgccggcggcggtcgtcgctggtgtccctgtgcttccgccgccgccgcccccggccaagaggctgtgcgtggcgccgcccaccggcgtggagcaccgggctccgccgcccgacccgcctacgtcgctgtcgctcagcccgccgggcgccgccgccgccgccatctcagcctccaccgtggtcggcgggtcgtcggcggcgcgcgcggaggaggaggccgtggcgagggagaaggcgaggatggagcaggacccgtggctgatggcgatgatgcggcagatgatcaccgaggaggtgcagcggcaggtgagcgtggtgtactcgctggtggcatcctccgcggcgatggcggcacagacgggcaacgccggcggcgtcggccggaaagggcccgacggccgcccatccaacggtcaggattga

SEQ ID NO: 2352 - protein, 303 aa, Oryza sativa (japonica cultivar-group)
  G4236,MYB-(R1)R2R3 domain coordinates 20-120
MLIHGEGSSSSAAAAGGKIKGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRNRRAAAAAAAAAASVSYQSMDLTEEADNDDEGTSDDSVAIPAQSSPAAVVAGVPVLPPPPPPAKRLCVAPPTGVEHRAPPPDPPTSLSLSPPGAAAAAISASTVVGGSSAARAEEEAVAREKARMEQDPWLMAMMRQMITEEVQRQVSVVYSLVASSAAMAAQTGNAGGVGRKGPDGRPSNGQD

SEQ ID NO: 2353 - DNA, 838 bp, Oryza sativa (japonica cultivar-group)
  G4237,family:MYB-(R1)R2R3
gaaggtaaatggggatgtgtagcaagacaaggaagaaggggtcgtggagggcggaagaggacgcgctgctgacgaggctggtggcgcagcatggcccccaccggtggagcatcatcagcggcgccatcccggggcgctccggcaagtcgtgccggctgcggtggtgcaaccagctgagcccggccgtgcagcaccgccccttcaccccgcaagaggatgccctcctcgccgccgcccatgcccgccacgggaacaagtgggccaccatcgcccgcctcctccccggccgcaccgacaactccgtcaagaaccactggaactccaacctccggaggtgcctccgccgccaagccaaattcaaatccaaggaccctgatctgctgcccgatccaattaatattccacctgactgcatcgtcgtgctcaacgacgacgacgagcctgcagatcggccggtcacgccgcccgccatcatccaggcccaggcccaggagacactaccgtcgctgaccctgagccttagcctttccctgcccggcgccgctgctgctgctgctgaggttgaggtggcaccgccgccgcccagggcactggcagctgcttctgagatccaagacggcagcagcagatcatcatcggcatcgcgtgtcatgttgcaggtgatgcgacagatggtgagggaagaggtgcagcgccatactgcgcagctcgcctactccctcatggccctggcctcctgcagccgtaggcccccaaattaggagcattcattttcagactttgttcaaacatcgatcgatcatcaaataaaaatttctcaggaggagttgcatgcttg

SEQ ID NO: 2354 - protein, 250 aa, Oryza sativa (japonica cultivar-group)
  G4237,MYB-(R1)R2R3 domain coordinates 10-110
MGMCSKTRKKGSWRAEEDALLTRLVAQHGPHRWSIISGAIPGRSGKSCRLRWCNQLSPAVQHRPFTPQEDALLAAAHARHGNKWATIARLLPGRTDNSVKNHWNSNLRRCLRRQAKFKSKDPDLLPDPINIPPDCIVVLNDDDEPADRPVTPPAIIQAQAQETLPSLTLSLSLSLPGAAAAAAEVEVAPPPPRALAAASEIQDGSSRSSSASRVMLQVMRQMVREEVQRHTAQLAYSLMALASCSRRPPN

SEQ ID NO: 2355 - DNA, 906 bp, Oryza sativa (japonica cultivar-group)
  G4238,family:MYB-(R1)R2R3
atggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtgagccccgggccggggagcccgacgggatcggagcgcagcgagctcagccacggcggctgcggaagcggaagcggcggcgggcaggtgttccgccccgtgccgcgccccggcggcttcgacgccatcagcgcggcggacgtcgtgcggccgccgcggcggcgggacgacaacgacgacgacggcgacgacgacccgctcacctcgctgtccctctccctctccctcccggggttccaccacgacagcgcgcggagccacttccaggagctcccctccccctcccgctccccttcgccgccgccgtcgccgccggcagcatctccatccgcatacccgttcaacgccgatctcgtctccgcgatgcaggagatgatccgcacggaagtccgcaactacatggccggcgtcgggctccgcgccggctgcggcccgggcgccgtggccgagtccttcatgccgcagctcgtcgacggcgtcatgcgcgccgccgccgagagggtcggcgtcgtgacccgccaataa

SEQ ID NO: 2356 - protein, 301 aa, Oryza sativa (japonica cultivar-group)
  G4238,MYB-(R1)R2R3 domain coordinates 11-111
MGMEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDGDDDPLTSLSLSLSLPGFHHDSARSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 2357 - DNA, 1003 bp, Zea mays
  G4240,family:GARP
atctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccttttca

SEQ ID NO: 2358 - protein, 258 aa, Zea mays
  G4240,GARP domain coordinates 141-189
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHK

SEQ ID NO: 2359 - DNA, 1243 bp, Oryza sativa (japonica cultivar-group)
  G4241,family:GARP
ccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggaggcggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggctgcggcgcgcgtcgtcgtcgtcgtcgagctcgttcccggcgttcgcgtcgaagggagcgggagcgggagcggacgaggcggagtcagggggaggcgcgaatggggggaacgggaacaccaacaacaacagcagcaagagggcgcggctggtgtggaccccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccactgatccattccttctcatcatcatttcatttccacatctatataccacatactactccataacgaaggtgtttcatcaataagagaagagaagagaagagaatgctccctcaactgtaaactcctaattctaattaagggcaaagtgtatccatccatccatccacgctgtttgtttgtagctgttgttaattgagctggatgcatgacatgtatctctatgtacctacctgcgtgacaaaggcatcatgcatatgtatggttcccttgcaatttggggaatccagaaatgattcatacttgtgattcttgc

SEQ ID NO: 2360 - protein, 238 aa, Oryza sativa (japonica cultivar-group)
  G4241,GARP domain coordinates 123-171
MGEEAPEEYELGGGEDERVMEWEAGLPGADELTPLSQPLVPAGLAAAFRIPPEPGRTLLDVHRASAATVSRLRRASSSSSSSFPAFASKGAGAGADEAESGGGANGGNGNTNNNSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 2361 - DNA, 1236 bp, Glycine max
  G4243,family:GARP
atgggggaagaggtgaagacgagcgagtacgacgaagagcgcgtgatggagtgggagatgggtctcccaaccgccaacgatctcacgcctctctcccagccgctgatcccgccggagctcgcttcggccttcagcatctcgccggagccccaccgcaccctcctcgaggtcaaccgcgcctcgcgcaacacgctctccacaatccgcggcggcggtagcgtgcaccaggccttctcatccaacaacaacaacaaccaccactacgacggcgacggagacggcggcgacgaggaggagtacgacgacgccgatcgcgatggctcggggtcggattcccggaagcagcggaagatcgactgcggcgtggcggaggaggcggactcggcggtgcggacagagacctcggcggagcgaacggcggtgaagcggccgcggctggtgtggaccccgcagcttcacaagaggttcgtggacgtggtggcgcacctcgggatcaagaacgcggtgccgaagacgattatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaatgaacctccaagattcaaaggcttgattattggtggtgtgtaattcacaccctgtaattcacattgatgattaccttgtaattcacacaaatggattattgaggaagtatatgaacaatactatatggagctagattacaatctgaatcagtagtgtgtaaccctgtgggagatttacaaacatattggtacacatctctaattcctgtcacctaattgtatgacgagaattctggcttatttcttctggtctgcctagacagctgattctaaagttaattcttaactagttctctgattcataaaaaaaaaaaaaaa

SEQ ID NO: 2362 - protein, 306 aa, Glycine max
  G4243,GARP domain coordinates 148-196
MGEEVKTSEYDEERVMEWEMGLPTANDLTPLSQPLIPPELASAFSISPEPHRTLLEVNRASRNTLSTIRGGGSVHQAFSSNNNNNHHYDGDGDGGDEEEYDDADRDGSGSDSRKQRKIDCGVAEEADSAVRTETSAERTAVKRPRLVWTPQLHKRFVDVVAHLGIKNAVPKTIMQLMNVEGLTRENVASHLQKYRLYLKRMQGLSNEGPSSSDQLFASTAVPQSLHDSAPPSAHSNGHGHLPVPMMSMPYPPPMMSMPYPPPMMSGMPHAHGHMGIPMPNSSATSAYHPYNMLHQRDWPHLAPNDK

SEQ ID NO: 2363 - DNA, 1599 bp, Glycine max
  G4244,family:GARP
tgtttcacacacatatatactctctctctctctctctctctctctctctctgtttgggttagggacatagaagaagagtgtgtgagagagacacggttaaatttgttttgttttatatacggttagaactaactgaatgggggaagaggtgaagacgagcgagtacgacgaagagcgcgtgatggagtgggaggcgggtctcccaactgccaacgatctcacgcctctctctcagccgctgatcccgccggaactcgcgtcggccttcagcatcttgccggagccccaccgcaccctcctcgacgtcaaccgcgcctctcgcaacacgctctccacgctccgcggcggcggagggagcgtgcaccaggccttctcctcctccaacaacaaccacaactacgacggcgacggcgacggaggcgtcgaggaggaggaggaggaggacgacgatcgcgacggctcggggccggattcacggaagcagcggaagatcgactgcggcgcggccgaggaggcggactcggcggttcagacggagacctcggcggagcggacggcggtgaagcggccgcggctggtgtggaccccacagcttcacaagaggttcgttgacgtggtggcgcacctcgggatcaagaacgcggtgccgaagacgattatgcaattgatgaacgtggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatgggcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccgccacctcagcttaccatccttataatatgttgcatcaaagggattggcctcaccttgctcctaatgataaatgaacctataaggtcagccatcaccatcatatgcaaaagattcaaaggcttgattattggtagtatagctttctgagaagggaggagctgcattgatgattaccctgtaattcactcaaaaggattattgaggaagtatatgaagaagagtatatggagctagattacaatcttagtcagtagtgtgtatcctgtgggagatttacaaacttattggtacacatctctaattcctgtcacctaattgtatgacgagaattctggcttatttcttctggtctgcctagacagctgattctaaagtaaattcttaactggttctctgattcataaattatagattcctattatattgtgtaatcctgaatgtgttaactctctttttcagaaccattgaataaaagaaagaccgaacaacagacaggaaacatttattggttgctctggccttaaatgttcttctttttcttatacctcttgatcattatttcctt

SEQ ID NO: 2364 - protein, 323 aa, Glycine max
  G4244,GARP domain coordinates 149-197
MGEEVKTSEYDEERVMEWEAGLPTANDLTPLSQPLIPPELASAFSILPEPHRTLLDVNRASRNTLSTLRGGGGSVHQAFSSSNNNHNYDGDGDGGVEEEEEEDDDRDGSGPDSRKQRKIDCGAAEEADSAVQTETSAERTAVKRPRLVWTPQLHKRFVDVVAHLGIKNAVPKTIMQLMNVEGLTRENVASHLQKYRLYLKRMQGLSNEGPSASDQLFASTPVPQSLHDSAPPSNHSNGHGHGHGHSNGRGHGHGHGHGHLSVPMMSMPYPPPLMSMPYPPPMMSGMPHGHMGIPMPNSSATSAYHPYNMLHQRDWPHLAPNDK

SEQ ID NO: 2365 - DNA, 1128 bp, Solanum lycopersicum
  G4245,family:GARP
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 2366 - protein, 314 aa, Solanum lycopersicum
  G4245,GARP domain coordinates 155-203
MGEEVSLTDYESSGGNDDRLLWEIGLPDVDDLTPLNMQLIPSELAAAFRISPELSKTMTDVNRASQNTFSSLQRWHSQDMASMNNSNFKTFSYERSREETVTERDETDLIREGSDSRKLRRVESGGTEEADSSLCNENFADDSSAKTLKRPRLVWTPQLHKRFIEVVAHLGIKGAVPKTIMQLMNVEGLTRENVAGHLQKYRLYTKRMQPNEGPSSSDHLLTSTPATEIMRESSESGHLRNTNGHMAMPTLMPYQQQMVAMPMMGMPNGGHVGMPVGYGGGPPLGFHHHYNVVQQRDWSGNNFGYYHPVASNDK

SEQ ID NO: 2367 - DNA, 1535 bp, Arabidopsis thaliana
  G425,family:HB
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 2368 - protein, 383 aa, Arabidopsis thaliana
  G425,HB domain coordinates 305-365
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 2369 - DNA, 1165 bp, Zea mays
  G4253,family:CAAT
tttgctggtggaacgtggaagaagagcgagaacgccaaacgagaaaagaaacccaagccttcgccatcaaaaaaaaaagaaaaaaagaaaaaaaaagagcagaaaaagtagagtagactacgacagcgtccggcgaggaggcggaggcgaagatgaggaagaagctcggcacccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaagaagaaagtcaaatggcagtgacccagagaatgatgaatcaagatctagtaaaatggccataagaaatgcaaacatcagccccagaggacgtgggaggggtcgaggcagaggacgaggtcggccaccaaccaagagaaaggaggttggttatgtacaatttgaagatgagagcagcatgtttgctgaacaaggtgagcccttgccaggagaggaaacagttcaagagatcaatggcaacgagaccatgcctcaaagcacgcaacctccagtagaggctccgccaacagcccttgcacaagctacaacaagttctaaggcggaagaagcgaacagtgatcatcagtcagattggcctatgccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgcttttttacatgattcaagtgttttgtcatatttaacacagtatttgagcaggggtcgactattacaaaaaaaaaaaaaaaaaa

SEQ ID NO: 2370 - protein, 254 aa, Zea mays
  G4253,CAAT domain coordinates 10-86
MRKKLGTRFPAARIKKIMQADEDVGKIALAVPVLVSRSLELFLQDLIDRTYEITLQSGAKTLNSFHLKQCVKRYSSFDFLTEVVSKVPDLGGADSCGDERGLPRRRKSNGSDPENDESRSSKMAIRNANISPRGRGRGRGRGRGRPPTKRKEVGYVQFEDESSMFAEQGEPLPGEETVQEINGNETMPQSTQPPVEAPPTALAQATTSSKAEEANSDHQSDWPMPDAIGSIGVVPSGFGHLTVQVEDEDYDNED

SEQ ID NO: 2371 - DNA, 1165 bp, Zea mays
  G4254,family:CAAT
tcggcgtcacaagacttcgtcgtcaccaaaaaaataaaggtcgtcaccaaaaaaataaagcagaaaaaaacagagagtagtagactacgacagcgtccgtcgaaccggagggtcggaggcggaggcggcgaagatgaggaagaagctcggcacccggttccccgcggctcgaatcaaaaagataatgcaagcagatgaggatgttggaaagattgcattagcagtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcagcaaggtaccagatcttggtggtgctgattcatgtggagatgaaagagtgttacctagaagaagaaagtcaaatggcagtgacccagagaatgatgaatcaagatctagtaaaatggctataagaaatgcaaataccagccccagaggacgtgggaggggtcgaggcagagggcgaggtcggccaccaaccaagagaaaggaagttggttacgtacaatttgaagatgagagcagcatgtttgctgaacaaggtgaaaccttaccaggagagggaacagttccagagatcaacagcggcaacgagattacgcctcaaagcacgcaacctccgctaacagcccctgcgcaagctacaaattctaaggtggaagaagcaagcaccgatcatcagtcagattggcctatgccagatgccactggaaacatcggtgttgggccatctggttttggacatctgacagtgcaggttgatgaagatgaggactacgacaatgaggactagtcagggccatcctctcactgtatgcgctaacaggactgttctggtgttgtaaaatgtaaatatagcttgaagtagctgccgcagcttagctatgattgtctgttatgaggttatgtagttgccctgtgtaacttctgtaattgctttttagttgccttttctctacatgattgactgtcaaagcgttttgtcatatttaactcaaaaaaagggagcacgctctaaaggattctaagtattttgactttattcaactagtatttgagcagtcctgtg

SEQ ID NO: 2372 - protein, 251 aa, Zea mays
  G4254,CAAT domain coordinates 10-86
MRKKLGTRFPAARIKKIMQADEDVGKIALAVPVLVSRALELFLQDLIDRTYEITLQSGAKTLNSFHLKQCVKRYSSFDFLTEVVSKVPDLGGADSCGDERVLPRRRKSNGSDPENDESRSSKMAIRNANTSPRGRGRGRGRGRGRPPTKRKEVGYVQFEDESSMFAEQGETLPGEGTVPEINSGNEITPQSTQPPLTAPAQATNSKVEEASTDHQSDWPMPDATGNIGVGPSGFGHLTVQVDEDEDYDNED

SEQ ID NO: 2373 - DNA, 1388 bp, Zea mays
  G4255,family:CAAT
cgaatttctatttaatgttcctgttcttcccctccgatccgatgtccccaactgcgctcccgtcggcgatcaaacaccggatcgcggcactcgccgccgttgaggaggaggtttccggcgctgcttccagcgccttgccgtcagcaccatgaggaagaagctggacacgcgtttccccgctcctcggattaaaaagatcatgcaaacagatgaagacgtcggcaagattgctcaagctgtacctgttctagtgtccaaagcattggagctatttctgcaagatttatgtgataggacatatgatattacaattcggaagggggtcaagactgtgggttcttcccatttgaaacaatgcatacaaacgtacaacgtctatgacttcttgagggaagtagtcagcaaagttccagacattggtccttctgatgttattgctgatgataagcttggcaaaaggaggaaagccgaagaagatggaagtgaggaagaattgaagaggacaagaaatgagacagaaagctatacaagcaatggcagaggccgtgggagaggtcgtgggagaggtcgccgtggtgtacgtggagcttggcgggaggtggtcacaagtcctgagcaattcaaggaggagaatcaatctagcaaggtagccagcctaaaggtggaggtagcagatgaggtctcgaatgtaactgaagcaaaacaggacactacaccaatgagcaacgccaggccttccttaaggaacattgacttgaatttagatccaaccgatgaagaggatgaggttacagtgccaccccaaccccagctgtcagctccagcaactagttgcgatgcagccactgcagcacctggaccatctgttccacggttaagggaaggagcaaaactcaaggacttctttggtgcttgggaactggctgacatgaacaagatggagatggaccctgtccagtttgctctgtcaacaaaccatagattggaggaggacgaggattatgacaatgaagactagctccgccgttatatagcttcagagttgatgagtaggaatagcaggacaactgtaggttcagcttaactctgtagcagttctcatgtatcatatagccgccaaagctgccgatgtagcttataatgtcccagaggttaaggtcgtttgactagttgactgtaatgttctcaagttaggttctattagcagctattgctttcgcagatagtaccgtttgtacattccagttgctctccagttttatgttatctatccttctgctttcttggatagctgagacctgttggcggatgtatcatgtatggcaagttggcaacaaaaagcaagaaggctttcagattcaaaaaaaaaaaaaaaactattacagtgg

SEQ ID NO: 2374 - protein, 289 aa, Zea mays
  G4255,CAAT domain coordinates 10-86
MRKKLDTRFPAPRIKKIMQTDEDVGKIAQAVPVLVSKALELFLQDLCDRTYDITIRKGVKTVGSSHLKQCIQTYNVYDFLREVVSKVPDIGPSDVIADDKLGKRRKAEEDGSEEELKRTRNETESYTSNGRGRGRGRGRGRRGVRGAWREVVTSPEQFKEENQSSKVASLKVEVADEVSNVTEAKQDTTPMSNARPSLRNIDLNLDPTDEEDEVTVPPQPQLSAPATSCDAATAAPGPSVPRLREGAKLKDFFGAWELADMNKMEMDPVQFALSTNHRLEEDEDYDNED

SEQ ID NO: 2375 - DNA, 1278 bp, Zea mays
  G4256,family:CAAT
agcgatcccaatccccgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggtcaggacacttattgattttcaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaagaacgacattgcagctgccatcaccaggactgatatatatgacttcctggtggacataatcccgagggatgaaatgaaagaggaggggctcggacataatcccatagttggcctgccgcctgctatgggggctccagctgatcatggttctcatccatattactatgtgccagctcagcaggtgcaaggagcaggtatgatgtatggtggccagcagggtcacccagtgacttatatgtggcagacgccgcaagggcaagcggcagagccccccgaagaggagcagcagcagtctgcctgaatgtagcaaatagacgataacagcgaagcaattacatcttatctgaagttctgaacttagttctctaaacaaacaaatatgatttggttatgttaattgtgcagatgattgcaggctgaaacaattgtcgctaattaggtgtcatagcctcatagggtttcctaatggtagtttcgactcccgacgctgccacggcagcagtagaaaatgattgtaatttgcagactaatgtagtaagattagccttttctgtctaatccaatatacgattgaggccctcgaaaaaaaaaagaaaaaaaaaaaaaaaa

SEQ ID NO: 2376 - protein, 251 aa, Zea mays
  G4256,CAAT domain coordinates 84-180
MEPSSQPQPMMGVGSQPYPAAAPYVPVPGSLAVPPGSQPAAAFPNPTQLSAQHQMVYQQAQQFHQQLQQQQEQQLREFWTTQMDEIKQANDFKIHTLPLARIKKIMKADEDVRMISAEAPVVFAKACEVFILELTLRSWMHTEENKRRTLQKNDIAAAITRTDIYDFLVDIIPRDEMKEEGLGHNPIVGLPPAMGAPADHGSHPYYYVPAQQVQGAGMMYGGQQGHPVTYMWQTPQGQAAEPPEEEQQQSA

SEQ ID NO: 2377 - DNA, 1158 bp, Zea mays
  G4257,family:CAAT
ggaggggactaggggagagagagagggggaaggccaagaagaggcttcctctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccagcaagctcaacagttccaccaacagctccagcagcagcaacagcagcagcttcaccagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgacttcttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaggagcaagctcctgaagagcagcagtctctgcatgaaagggactgaggatgtcgctcaagctatcacctgatttttcagagctctcattttaggttctctaaactgcaggttttcgttggctaatatcgttgggtatcaaactgaaacaggtagggtgtagcatcatggtagtttgatttctgctgtggtgttagttggagggataatgattagcggctagtggattaaagttacccatacc

SEQ ID NO: 2378 - protein, 255 aa, Zea mays
  G4257,CAAT domain coordinates 90-186
MEPSSQPQPAMGVAAGGSQVYPASAYPPAATVAPPAVASAGLQSVQPFPANPAHMSAQHQIVYQQAQQFHQQLQQQQQQQLHQFWVERMTEIEATADFRNHNLPLARIKKIMKADEDVRMISAEAPVVFAKACEIFILELTLRSWMHTEENKRRTLQKNDIAAAITRTDIYDFLVDIVPRDEMKDDGIGLPRPGLPPMGAPADAYPYYYMPQQQVPGPGMVYGAQQGHPVTYLWQDPQEQQEQAPEEQQSLHERD

SEQ ID NO: 2379 - DNA, 1243 bp, Zea mays
  G4259,family:CAAT
aaaaaaagaagcttgccatttcgctcagggccctgcaacgcgcggcagcgcgccacgcgccgagcttggcttgggactgggccgcccggccgcgaggaataaactcactcctgccttcatacgtatccaaatagccgcggcagtacgtgtatgtggttagctatacgcgacctcagctcgggcgcaagctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatattctacagcaaacgtggtaatggagctgctatgcatacagaacgaataaggcgtgacgtgtgagaccgtaagagtacgtagtactaatatgtagatgcacgtgacgtgccaattaatcaaagattaacatgcagttaattaattagatcctccct

SEQ ID NO: 2380 - protein, 245 aa, Zea mays
  G4259,CAAT domain coordinates 55-153
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 2381 - DNA, 1505 bp, Zea mays
  G4261,family:CAAT
gcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgctaatatttaaataaacaccttgacccggccgggcgcggagtaattttatattttttatattcgggagtccacacaatcgtgtaaggttcctgcgaaccagttctgactttaattgaaccgcccggattcatatg

SEQ ID NO: 2382 - protein, 264 aa, Zea mays
  G4261,CAAT domain coordinates 175-234
MSSMESRPGRTNLVEPIGHGAALPSGGQAVQPWWTSSGAVLGAVSPAVVAVAPGSGTGISLSSSPAGGSGGGGAAKGAASDESSEDSRRSGEPKDGSASQEKNHATSQIPALAPEYLAPYSQLELNQSIASAAYQYPDPYYAGMVAPYGSHAVAHFQLPGLTQSRMPLPLEVSEEPVYVNAKQYHGILRRRQSRAKAELEKKVVKARKPYLHESRHQHAMRRARGNGGRFLNTKKSDSGAPNGGENAEHLHVPPDLLQLRQNEA

SEQ ID NO: 2383 - DNA, 953 bp, Zea mays
  G4267,family:CAAT
ccttcatccacgaagagctgaagatatcacatgactagttgcagttagtgtggcttttctccctgcttggtcctgattgtgtgctttgccttgcaaaggaaggaatcatgacctctgttgttcagagcgtttcaggtgaccacagggctgaggatcaaagtcatcagaagaagcaaactgaacctggggaccagcaagaagccccagttactagttcagatagccaaccaacagtgggcacaccatcaacagattatgtggcaccctatgcccctcatgacatgagccatgcaatgggtcaatatgcttatccaaatattgatccatactatggaagtctttatgcggcggcttatggtggacatccattgatgcatccaacattagtcggaatgcatccggctggcttacctttgcctaccgatgcaattgaagagccagtgtatgtaaatgcaaagcaatacaatgccatattaagacggcgtcaatctcgggctaaagctgaatcagaacggaagcttgtcaagggccgcaagccctatctccatgagtcacggcatcagcatgccttgaaaagggccaggggagctggaggtcggtttctcaattcgaagtcagatgacaaggaagagaactccgactcaagtcaaaaagagattcagaacggagttgcgccccaaaagggtggccaaccgtcaacccctccgtctcccaacggtgcgtcgtcagcttatcaggcgcctagtcgtgaatgatgattcggaactcacaactgaagagattttagtccctgacgctagttgtggcagcagctttgtacagtaagtgctagcgggcagcagcgaaatggtgtcatagaaaaacgttgacgagtcagacaggttttggagtcttggttttttttcctctgtttattttacctgtctgcaattttagtagctttgtgtcccttc

SEQ ID NO: 2384 - protein, 215 aa, Zea mays
  G4267,CAAT domain coordinates 110-169
MTSVVQSVSGDHRAEDQSHQKKQTEPGDQQEAPVTSSDSQPTVGTPSTDYVAPYAPHDMSHAMGQYAYPNIDPYYGSLYAAAYGGHPLMHPTLVGMHPAGLPLPTDAIEEPVYVNAKQYNAILRRRQSRAKAESERKLVKGRKPYLHESRHQHALKRARGAGGRFLNSKSDDKEENSDSSQKEIQNGVAPQKGGQPSTPPSPNGASSAYQAPSRE

SEQ ID NO: 2385 - DNA, 1228 bp, Zea mays
  G4268,family:CAAT
cgcgcgcagccctcgtccggccgcccgggtccgagcccgctcgctcctcctccccacgttggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatgattcaaaactcacagctgaagagatttcagcccctgagctagatatggcagcagttttgtacagaaaacgctagtgggcagcagcaacatggtgtcgatcggtcggtcggttgttgtaggacatgttccatagaaaaagcatagacgagtctacaggttttggagccttggtttggtcctctgtgtattcacctttctgtacaatcttagtagcgttgtgtaccttcccctggaaggatagcttcagttagcgcttcagaaagtcaagtgtgtagcatattggcttattgtttgctttgcttggacaatggagatttgggagtggagttcataaccctgctgaataaatactcttagctggctatgtgtatgttggacgacaatatgatccctaatgtagtacacgtgaccacctc

SEQ ID NO: 2386 - protein, 214 aa, Zea mays
  G4268,CAAT domain coordinates 110-169
MTSVVHSVSGDHRAEDQNQQKKQAEPGDQQEAPVTSSDSQPTVGTPSTDYVAPYAPHDMSHAMGQYAYPNIDPYYGSLYAAAYGGQPLMHPPLVGMHPAGLPLPTDAIEEPVYVNAKQYNAILRRRQSRAKAESERKLIKGRKPYLHESRHQHALKRARGAGGRFLNSKSDDKEENSDSSHKENQNGVAPHRSGQPSTPPSPNGASSANQGRQS

SEQ ID NO: 2387 - DNA, 1501 bp, Arabidopsis thaliana
  G427,family:HB
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 2388 - protein, 393 aa, Arabidopsis thaliana
  G427,HB domain coordinates 307-370
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 2389 - DNA, 1069 bp, Zea mays
  G4272,family:CAAT
ttgggtacctcgaggccggccgggagagactcgccaaatttccctccctcctcctagccttctcgtcgctcctgttcttctcgcatcctgctctcccatccccatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattactgctgcctgtatgtaaatcaaaatctgaggctcccatttcgaaacggacggtgaactactcttcccgtttcgtttcatacgagaatcgaactcgttttcaatt

SEQ ID NO: 2390 - protein, 220 aa, Zea mays
  G4272,CAAT domain coordinates 22-118
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 2391 - DNA, 543 bp, Zea mays
  G4276,family:CAAT
ctcctcttctccagcgtccgatccccgtttcccacgaatcccactctactcctccatctgcggcctcctccattctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctaaggagataatgcagtactgcgtctccgagttcatattctttgtgacgagcgaggcgagggagaaaagcaaaaaggaggagcgtaagagaatcaacgtggacgatttgctctggtcagtggatacggcaggattcgagtacgtggagcttctcaggatttgcctacaaaagtacagagagacggggaagtgcacggtgtacacgacgtgatcaggttattaacctgtaacaccttaatgaga

SEQ ID NO: 2392 - protein, 117 aa, Zea mays
  G4276,CAAT domain coordinates 19-108
MADDSGSHEGGGGGGDDVREQDMFLPITNITRIMKKAVPANAKITKDAKEIMQYCVSEFIFFVTSEAREKSKKEERKRINVDDLLWSVDTAGFEYVELLRICLQKYRETGKCTVYTT

SEQ ID NO: 2393 - DNA, 1232 bp, Zea mays
  G4283,family:AP2
ctcgtctgtctctccttgcctgtgcgcttcggttattagctagctagcttgggtctagtctagtgtaactcccggccgccatctttgctgtacttcgttcgtccatgtcgcgctcgcgcacggtgcggatcttctgggacgatcctgacctgaccgattcctccggcgacgacgagggctgcggagcccggagggtcggcagaatggtgagggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcgccgcagcctggccgtcctcgaggaggaggagctgggcgagttcgtgccgttcgaggacgcgcccgtctacgccaccagcggcttctgggacttcgagcccgacgcggggttcctctacgccgagccgtcgtcgccggaggcgtcgtggaatgccgccgccgccgtcgccgagcccgcctcgtctgacgacgcgcccagctgggccgcgtcgccggtgcaggagaacgactacttccaggacctgcgcgacctcttcccgctcaaccggcttcccgcgattttctgaacaggtggacggggaacgccggaaccgggaacggcgccgctggttcgtctaccgggatgttattttggacgtcgagagtgcgctgtgtctgtgtctgtgtctgtgtcgtgcctacgcgcaccgtgtacttgtacgcctttccccacgccgtttttgttactatcttcgagtcgatgagaaatgtggaaatatgctgccgaacgatgagcacgtagagttttg

SEQ ID NO: 2394 - protein, 301 aa, Zea mays
  G4283,AP2 domain coordinates 90-152
MSRSRTVRIFWDDPDLTDSSGDDEGCGARRVGRMVRELAPAPAPAPAALPVPDQCNAGDGDRGRKAGVAGPGVCSGARRRVAKGAGGPASTKFRGVRRRPWGKFAAEIRDPWRGVRVWLGTFDTAEEAARVYDTAAVQLRGANATTNFAASAATNSGSGAGAGQDPATTPAAGYESGAESSPTSVLRKVPSLSSLAEDDSDAPAAERRSLAVLEEEELGEFVPFEDAPVYATSGFWDFEPDAGFLYAEPSSPEASWNAAAAVAEPASSDDAPSWAASPVQENDYFQDLRDLFPLNRLPAIF

SEQ ID NO: 2395 - DNA, 1179 bp, Zea mays
  G4284,family:AP2
acccctcactcagcccgtccccttttcccccattgggtccccggaggccggccggggtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaaccggctggggcaagctcggccgttcggttccgtggcgtccgtcgtaggccgtgggggcgctgggctgcggagatccgcgacccgcacaaccgccgcagactgtggctcggcaccttcgacaccgctgaggaggctgccaacgcctacgacgctgcgaacatccgcttccgcggtgtcagcgccactaccaacttccctgcggcccgctactcgccccctccaaagccagcgaagcctatcatctcgctgactcctgaacccggaaaggtgatcaccttgccaccggtacctgtgaagccaaccttccctgttcaggtgaaggaagtgggtgggagctggggcggcctggtcaagggagctaggtcggaggtcaaggcgtttgcaccgaagccagtatggaagatgatccccagggtgcaccagaagtttccgggttgtgccgatggctctggcctgcgtgccgtccatgctgcctccatctacgtggaggaggttggcggtggctgatggtccaagtatctgcaattactatcgctagaggttttattgtctatctccatggcatcattataacctggtactgtattattttggttagtgttaaactgttgatgtggaaacctatgactcttgctgtgttatgatcggtggtaatataatgtgtatatggtgacatttggtaataaaaaaaaaaaaaaaaaaaaaaaaaaaaaaaaaaaaaaagaaaaaaa

SEQ ID NO: 2396 - protein, 238 aa, Zea mays
  G4284,AP2 domain coordinates 77-139
MGTNPHLQELAASAVAASEPPPRARVVRILVHDADATDSSSSEDEAPPLLPRRRSRGGSSSLSVRRRVMEPAGASSAVRFRGVRRRPWGRWAAEIRDPHNRRRLWLGTFDTAEEAANAYDAANIRFRGVSATTNFPAARYSPPPKPAKPIISLTPEPGKVITLPPVPVKPTFPVQVKEVGGSWGGLVKGARSEVKAFAPKPVWKMIPRVHQKFPGCADGSGLRAVHAASIYVEEVGGG

SEQ ID NO: 2397 - DNA, 1813 bp, Glycine max
  G4285,family:AP2
cccacgcgtccgctctacctcccactctcacaatccctctctctctttctatcttcactccggctattacttattagcataactctcttttgctctgccttcccgccaaaacccttctctgtgatcaccaaggattcaaggttgagcgttgaattcttgaaccttgttgttgttgttgttgttgatgtgagtggagtgagatttcacttgaagcgcatccaaagttggccatattctcttctctctttctctctctctcttggaatatatctctagagacgaaaagcaaaagttgttacccataaaacatcttggtttttctttctgcttcaccaccaccaaaagtgtttccaaacgtctcaattcccccccagcatatacatctacttgtccacttttcccccataccctctaaattcttctcttactctttaaaccccacccttcatgcactccagccaacaccatcacacaacaaccttccctcttccctctctcactcaaacaaaaacatccttaaccactccaaaaacactcttttaggcatgtccgtacacgcaaaactgaagcaccaccccatgaacctagcatccccaagttcccattttgaggacgacccaccatgcaaaaccaagaccaaaacccaaaggaggctccttcggatcataatcaccgaccatgacgccaccgattctgactcctccgacgaagaacaacagcagcagcaacaaaaaacaagaagagtgaacagagaaatcacccaaatcaacatgcaacttcctctatcacataatagttccttttccccttcatcttcttattactcttcagcttccacctcatcggaacaaaacctaaagtgcaagagacccaacaaaaagccgccaccttcctccgccgaggcccgccgccgcaacaagttccgcggcgtccggcagcggccgtgggggcggtgggcggccgagatccgcgaccccacccgccggaaacgcctctggctcggaaccttcgacacggcggaggaagccgccacggagtacgacagagccgccgtcaaactcaagggccccaacgccgtcaccaacttccccctcgcgccggaggctacggcgcagtctccaccgctcgccgcggacaacctcagctccgacggcggcgcgtcgtactcggacctagtggcctcgccgacgtccgtcttggcctacgagtgcgactcgacgccgttcgacggtttccgttatctcgacgttgacgcgttcgggttccacatcgacgcgccgttaagtttgccggaagttaacgttaacgttgcgctgacgtgtcatcacgggaagaagcaggaggaggcgtttgatgaattcgatctggacgagttcatgacgtggccttactagtgataaaaatctcagggacagtttggtaaattacaccctgtttgcattgcggaagtgtgagttggaaatcccgaaattgcccccctccccctctcgttgtccaagtttgaaattttgtcgtactcgttggagctttggaagagtgtagagttgttggtacaaaattttatgtagtcgcattttactaccacctgaaacggcgattctttgtgtcgtatttggtagagtttaatttgtagttattatcatgaaaagaagaaaaaaaaaatgaagtgtcaaaactagtgagtgagaaaaggagaaaaggaaagatggtgttatttgagaaggaaggactatattgtaatttcggtatataaattttgataattatttaaagaaactttggtattgtctatatatagatcatgggttaactt

SEQ ID NO: 2398 - protein, 282 aa, Glycine max
  G4285,AP2 domain coordinates 123-185
MSVHAKLKHHPMNLASPSSHFEDDPPCKTKTKTQRRLLRIIITDHDATDSDSSDEEQQQQQQKTRRVNREITQINMQLPLSHNSSFSPSSSYYSSASTSSEQNLKCKRPNKKPPPSSAEARRRNKFRGVRQRPWGRWAAEIRDPTRRKRLWLGTFDTAEEAATEYDRAAVKLKGPNAVTNFPLAPEATAQSPPLAADNLSSDGGASYSDLVASPTSVLAYECDSTPFDGFRYLDVDAFGFHIDAPLSLPEVNVNVALTCHHGKKQEEAFDEFDLDEFMTWPY

SEQ ID NO: 2399 - DNA, 1304 bp, Glycine max
  G4286,family:AP2
gaacatctctgtctctctctcttccttaccccttgcaataaccaccctaaaccctcccatcttctcacacctagcaaattactgccatcaacttattttccttcatcacccaccactctctatttctcacttgcttcatgcaattaaaactaccactaccacctttttccatttccttactcttttcttcaataaaatgagtgacacacaccaaactttcatgtccgtacaaccacccctgaatctccaccacccctttaacccacaagcctcaagctcaaattttgacggcgacccaccatgcaaaaccgccgcaaaaaccaaacctccgcgcaagaagctactccgggtaattctcaccgaccatgacgccaccgattctgactcctccggtgacgacgacgacccaaaaaacccaccgaaacacaaaaaggtgaaaagacaaatcacccacatcaccataaaccttccctctttctcagaagccccaactccagcaccaataccaacaccttcttcgtcttcttctattgatccgacccgtttaaccctacccaagaaacgacccgccgtgcctcgccgccgtagcaagttccgcggggtccggcagcggccatggggacggtggaccgcagaaatccgtgacccgaatcagagaaaacgggtctggctcggaacgttcgacacggcggaggaagccgccgccgtgtacgacgacgccgccttgaagctcaagggccccaacgccgtcactaacttccccctctccgccgccggaaaaacggaacatgataccgcgccgccggaggcggctttctccggcgaaggtttttcatctcccacttccgttctcacttactttgacggagactcgacgccactttacggtttccgttacggcgaggtcgacgcgttcgggtttgacatcgatgcgccgtttagtttgacagacgttaacttaggggtgctgagtcagcggttcgggaaggaagatttccgcgaggttgacccggacgagctcttgacgtggccgagttaaggggcgtatttatcatttcgaaaaaaatacagggaatgtttagtaattctaatgaagtttttttgtcgtattctgcattgaattccgaaactaccctcgtgactaagtttttgtgcagcttagtagagtgttagagagcaatagagtgatccaagtagtagtagagaattttgtcctatgttaatttgtgtaattaattgtattgttatggagaaagaggatatgatggaaagtattagaatgattctcttgtagtttcttatat

SEQ ID NO: 2400 - protein, 280 aa, Glycine max
  G4286,AP2 domain coordinates 130-192
MSDTHQTFMSVQPPLNLHHPFNPQASSSNFDGDPPCKTAAKTKPPRKKLLRVILTDHDATDSDSSGDDDDPKNPPKHKKVKRQITHITINLPSFSEAPTPAPIPTPSSSSSIDPTRLTLPKKRPAVPRRRSKFRGVRQRPWGRWTAEIRDPNQRKRVWLGTFDTAEEAAAVYDDAALKLKGPNAVTNFPLSAAGKTEHDTAPPEAAFSGEGFSSPTSVLTYFDGDSTPLYGFRYGEVDAFGFDIDAPFSLTDVNLGVLSQRFGKEDFREVDPDELLTWPS

SEQ ID NO: 2401 - DNA, 2226 bp, Glycine max
  G4287,family:AP2
ctgaactcttgttcttctttaccgattcaacaacagctcagcagtggtagtacccatgagcctgcagaatctgcactttttttgccttggcttctattctctcctcactttgaatcggaagatatcctttccattcaaggcagcaagcagaagtttcaacgaaagtctcctctcccacacagctactatcttctcaacactattggaatcaccatcatctgaataattcccttttttctttctctttctctcacacacccccatgatgtcaaaagttgttattttctctttattcctatcatcagtcccgaccatgtcttaatatttctttctttcttctttttcaaccttttggaagatttcggtttaaccttccccttcacgattctctctccctctctccctcttattcccaaaccaagcccctatttgtgttcatttcgcgtcacattagaataagaaacgcaatatggaagacagtatcctatgcaaacacacagtgcatcacaccgttaccaagaaactcatctcccccaaaaaatcatcccaaaccaattcgacgacagagcgcagaatagtgcggatttcatacactgatccagacgcaaccgactcctccagcgacgaggaaggtttccccttcgttcgccaaagaatgaagcgctatgttaaccagattgaaatagaaaccgccgccgccgaaaaagttgttcggaaaaggcccgccggtgaggcttgccgccggccggcgaagcttcactccgggaagaagttccgcggcgtccggcagcgaccgtgggggaaatgggcggcggagattcgggatccggcgagaagagtgcgtctctggttgggaacctacgacaccgccgaagaagctgccatggtctacgacaatgccgctattcgtcttcgtggccctgacgcgttaacaaacttcgtaacgccgcctcaaagagattctccgtctccgtctccaccgccggcggcggcggagactccggcggaggtttgcgagatgaaggttgtggtcaccgaagaagcctccggctccggctacgactccagcgaggatcattgccaccacaacctctcctctccgacttcggttctccagttccgaagcaactcgagcgaagaaaattccgagtctcagcagaaagcagaacaagtgttgagagaatgcgagggtgagacagaaacgagtttgttcgaggaaacgggtgagtttttggcgctggataacatgcctttgcctgcctgggatgacgtgttcaatttcgaaacgccagagtaccctcctcttctgtttcaagaggaggagaatctgaatctacttcatcagtcccagatgttgggcgaaacggtgcagttttcctcggaggaagggttcagtgatgaaagcagtatcatgctggccgactcgctcatagatttcgacagagcctgcccttcaccatcctccttgtgccaagtggacgatttcttccaagacattttgtttgcttctgatcctctcgttctgctctgaacactcttaaaacttactaaactgtcattcgttaatcgtcaatcgtccacttcacggcttgcccaatattcatggcagatttttgcttccggtggtaaaaaaaaaatgcctagtttctatttaattaaaatactatatatatatatatatatatatatatatatatatatatatatatatagttttatttgcgtatttatttagatgttttagatgctccgttacaaatagctaacggggggatgagttgagaacttgtgagcgaagttttgtttagtttttggttatatttgtaatctttttgcttaataagtaggatcgtacgttgagacttgagaatgtaatgtatatttgtccagatgttaatctaagtgtaatggcgttcttttctttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2402 - protein, 353 aa, Glycine max
  G4287,AP2 domain coordinates 99-161
MEDSILCKHTVHHTVTKKLISPKKSSQTNSTTERRIVRISYTDPDATDSSSDEEGFPFVRQRMKRYVNQIEIETAAAEKVVRKRPAGEACRRPAKLHSGKKFRGVRQRPWGKWAAEIRDPARRVRLWLGTYDTAEEAAMVYDNAAIRLRGPDALTNFVTPPQRDSPSPSPPPAAAETPAEVCEMKVVVTEEASGSGYDSSEDHCHHNLSSPTSVLQFRSNSSEENSESQQKAEQVLRECEGETETSLFEETGEFLALDNMPLPAWDDVFNFETPEYPPLLFQEEENLNLLHQSQMLGETVQFSSEEGFSDESSIMLADSLIDFDRACPSPSSLCQVDDFFQDILFASDPLVLL

SEQ ID NO: 2403 - DNA, 1817 bp, Oryza sativa (japonica cultivar-group)
  G4288,family:AP2
aacagcaaccaacaaacacacgcgaagaggcacacatctccgccttcgtgttcctcttcttctctcctcctccccccatccatccatctatcgcaccacctcccccgaaaaaatcccaccaatacctcatcgccttcgtccccttcctcgcttccacgccaaaagtcgttcgcttttccctcccttccttcccccccgtctccttgtgggttttgggaggggtggttcctcgaggtgtaggtgggtggcgcgctggcttcttcttggccgcgagggttttaggaggtttcttgagggttttggagtggtggtggtggaggattggagttggggtctgatgcgagtggagtgatgatgatgtggcctttggagatggaggaggggtttgtggctctcaagaggacggagcatgtcgaggtgacgtccttggcggtggcggtcgaggcgacgccgtcggcgaaggggggaaaggggaaggttgtggtgggtggtggtggcgccggcggcggcgttgggccgacgagggtgagggtgttctgtgatgacttcgacgcgacggactcgtcgagcgatgaggatgaggaggaggtgaccgcgcggcggagggtgaagcgctacgtgcaggagattcggttacagcgcgcggcggcggtggccgtgccgccggtgaaggtgaagggcgaggaggtgttcccggccgcggtgtcggcgaagatggcggaggccgcgaaggcgagggtggtgttggcggctgggaggaagaggaaggccggcggggtggacggcgccgagccgcggttccgcggcgtgcggaggcggccgtgggggaagtacgcggcggagatccgcgacccgtggaggcgggtgcgggtgtggctcggcacgttcgacaccgccgaggaggccgccaaggtgtacgacacggcggccatccagctacgcggccgcgacgccaccaccaacttcaaccagtccggggactcggcaagcctcgacgtcccacccgaggtcgccgagcgcgtcccgcagccgccgggggcgtccaagaacgcctccccggccacctcctacgactccggcgaggaatcccacgccgcggcggcctccccaacctccgtcctccgttccttccctccctccgccgtcgtcgcgaccgccgacacggccaacaagaagcagccgccgccgccgcctctcgtcgtccgcgagaccgacgagtcggtcgacgtcttcggctgctccttctccgacgacggcggcttcgccggcgagctcccacctctctacaccgacttcgacctcctcgccgacttcccggagcccccgctggacttcttgtccaacctccccgtggagcccttctccctggctcccttctccagcaacaatgggtcaccggacctccacctcgacgacgccccatcgccggcggcggcacaagtggacgacttcttccaagacatcaccgacctgttccagatccccgtcgtctagtgcagcagcaagaactgtaaaacaccggattaggagactaatccggcccaattttgtttgcgttttctctttttttttttcttctttattttttcgtttttagaggagaggagagttgagttaatgattccccgtcagtctagctgcggcagaacacccaccaccgcttcgtcaggggggaaagccttgacgaggcgagagagatgagaaagtcaaaagagaggcataaaacgagatcaatgttgttggggttatggtttttttgtaaaccatcgagaaaattaagttatcggtaattagcaaatactactactagtatcatc

SEQ ID NO: 2404 - protein, 380 aa, Oryza sativa (japonica cultivar-group)
  G4288,AP2 domain coordinates 147-209
MMMWPLEMEEGFVALKRTEHVEVTSLAVAVEATPSAKGGKGKVVVGGGGAGGGVGPTRVRVFCDDFDATDSSSDEDEEEVTARRRVKRYVQEIRLQRAAAVAVPPVKVKGEEVFPAAVSAKMAEAAKARVVLAAGRKRKAGGVDGAEPRFRGVRRRPWGKYAAEIRDPWRRVRVWLGTFDTAEEAAKVYDTAAIQLRGRDATTNFNQSGDSASLDVPPEVAERVPQPPGASKNASPATSYDSGEESHAAAASPTSVLRSFPPSAVVATADTANKKQPPPPPLVVRETDESVDVFGCSFSDDGGFAGELPPLYTDFDLLADFPEPPLDFLSNLPVEPFSLAPFSSNNGSPDLHLDDAPSPAAAQVDDFFQDITDLFQIPVV

SEQ ID NO: 2405 - DNA, 1029 bp, Oryza sativa (japonica cultivar-group)
  G4289,family:AP2
atggtggaagttatcgtggagaagaaggcgcgaaggattgtgagggggaggtggcatgtggaggcgagcaacgaagcggcggcggcggcgccggctgttgccgcgcccgcgcccagggttgttcgggttctctgcagagaccacgacgccacggactcctccggcgacgacgatggcgaggacgacgcgccgcggcgtgctcgcctcctcgtgcacgagatccacgtcgcgcggcagccggtggccatgtcgccagcggcggcgagctccagccagagacgtcgtgtcggcccgatgaagaggacggaatcggcggtggatgcgacgatggacgcgacggcggcggcgccggagaggaagttccgcggggtgaggaagcggccgtgggggaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaaggaagaagacgactccgcccccgatatcctcggcatctccgccggcgacggcttaatctccccgttcacctgcgacgtcctgaatttcccaccgcccgacgaggacatgttcggcggcggcatctccttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacggaggtggacggcttcttcagcgacgtcggcggcgacgacctgttcgccgccgagccgttcccggcgctctga

SEQ ID NO: 2406 - protein, 342 aa, Oryza sativa (japonica cultivar-group)
  G4289,AP2 domain coordinates 118-180
MVEVIVEKKARRIVRGRWHVEASNEAAAAAPAVAAPAPRVVRVLCRDHDATDSSGDDDGEDDAPRRARLLVHEIHVARQPVAMSPAAASSSQRRRVGPMKRTESAVDATMDATAAAPERKFRGVRKRPWGKYGAEIRVSQQSARVWLGTFDTAEEAARVYDHAALRLRGPSATTNFPMTPAAPSPPPSRATYAGAASGYDESSDESQLVGSPVSVLRPMPARATAKKEAKEEDDSAPDILGISAGDGLISPFTCDVLNFPPPDEDMFGGGISFGEPTPPPMVFDDDCMARLGHAPNDDEHPVTSSSFLDGDLGDLPSWTEVDGFFSDVGGDDLFAAEPFPAL

SEQ ID NO: 2407 - DNA, 968 bp, Oryza sativa (japonica cultivar-group)
  G4290,family:AP2
aagagaggagcagtaaagcactagttccacccataatcttggtacgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggaggggctggcgcgccgagcaccaagttccgcggcgtcaggcggagcccgtggggcaagttcgcggcggagatccgcgacccgtggcgcggcgtgcgcgtctggctcggcaccttcgacaccgccgaggcggccgcgcgcgtgtacgacaacgcggccatccagctccgcggccccagcgccaccaccaacttctccgcctccaccaactccgcgggtgcacaagatcgggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttttaaaaacgggatgggcttcttcaatcacggaaaaaaaaaaaa

SEQ ID NO: 2408 - protein, 292 aa, Oryza sativa (japonica cultivar-group)
  G4290,AP2 domain coordinates 93-155
MSRSRTVRIFWDDPDLTDSSGEDEGCGGRRVGSMVRELPPAQMPVAQAAAAAALPEQCSGGDGDMGRRVVGGGCTVGVGRRRLTKDGGAGAPSTKFRGVRRSPWGKFAAEIRDPWRGVRVWLGTFDTAEAAARVYDNAAIQLRGPSATTNFSASTNSAGAQDRVAVGYESGAESSPAVSSPTSVLRKVPSLCSLAEDKDDYEAGPCEPATAAGSNLTVLEEEELGEFVPFEDAPVYGGSSFWDFEPESGFLYAEPSSPETPWDAGATSSGEAQDYFQDLRDLFPLNPLPAIF

SEQ ID NO: 2409 - DNA, 1218 bp, Oryza sativa (japonica cultivar-group)
  G4291,family:AP2
ggtcttcccgcttccattgcaaccccaccgcgccgcacgccgccgcatcgatcggaaccaaaccctaaccctaaaccctagcccccccacctcgccttccaccccccacgctcccatggcggggcgcggaggctacgcgtagccacatcgatcgaacaccctgtatggattgaggtgggtttcccgaggcatgggtacaaaccctagcctgcacgagctggcggcgggggcggcgccgcggggacgcgtggtgcgtatcctcgtgcgcgacgccgacgccaccgactcgtcctccagcgaggacgaggcggttgcggtggcgcagcctcggccgcggcggaggggtaaggtgggtggtggtggtggtggtggtgggggcgtgaagcgccgcgtgatggaggcgggggcgggggaggcgaggccgaccgcgcggttccgcggcgtgcggcagcggccgtgggggaggttcgcggcggagatccgcgaccctcacctccgccgccgcctgtggctcggcaccttcgacaccgccgaggaggccgccgccgcatacgacgccgccagcgtccgcctccgcggttccagcgccgccaccaacttcgcctccgtccgctgctgctcgctgccgccggagctacccaagccaactatttcaccgcctgaagcagctgtgaggccaatcaccttgccaattgggacagctaagccgacccttcttccacgggtgaaggaggaaggtgagagctgtggcggtcgggtcaaggaggaggccagtagctgtgaggtccaggtgcttgctccggagccaatgtggacgatgatttcaggcaagcgtaaggagcgatcgggctgtggaacccgtgtccgtgccttccatgctgtgtccgcctgtgtggaagaagttggcggggcctgagggtccaattatccgtaattactatcgttagcagctttattgttatgcatagcatcattggaaacttggtattgtgtaattttggttagtattgaacttatgatgtgaagatgactctgcatgtgacctgatttggtaaggttatgatgtgtatatacggtatggttgctgatatatgtgatgcagtatggtaggcttcgataaggtgttgtggaattagtatgttgcatctaaataagacctttgatgtgagatatagacatgttcttcgattagaataaaatatagtagaaaattattgc

SEQ ID NO: 2410 - protein, 241 aa, Oryza sativa (japonica cultivar-group)
  G4291,AP2 domain coordinates 79-141
MGTNPSLHELAAGAAPRGRVVRILVRDADATDSSSSEDEAVAVAQPRPRRRGKVGGGGGGGGGVKRRVMEAGAGEARPTARFRGVRQRPWGRFAAEIRDPHLRRRLWLGTFDTAEEAAAAYDAASVRLRGSSAATNFASVRCCSLPPELPKPTISPPEAAVRPITLPIGTAKPTLLPRVKEEGESCGGRVKEEASSCEVQVLAPEPMWTMISGKRKERSGCGTRVRAFHAVSACVEEVGGA

SEQ ID NO: 2411 - DNA, 1206 bp, Oryza sativa (japonica cultivar-group)
  G4292,family:AP2
cttggatgagatttggggtgacgtcctcgtagcgggcggtggatatgcgtcctccggcgatgtctccggcggactccctcgccgccggcaggagccgccgtgttggggctagcatgcctcggcccaagcgtgtccgcgtctacttcgtggacgccgacgccacggacaccgactcctccggggacgagcgctccaggccgcgcgtccgggaggtcatcgacatcgacgtcggggccgcctcgccggcgccggcgccgaagcacccgaggcggctggttccgacggcgacggcggcgctggcccggcggcgcgcggggatggcggcgagccggcggttccgcggcgtgcggcggcggccgtggggcaggttctcggcggagatccgcgacccgagcctgcagaagcggctgtggctcggcaccttcgacaccgccgaggaggccgccgccgtgtacgacgacgccgcgctccgcatcaagggctcccacgccgtcaccaacttcccctccgactccgacaccccctccgccaaggccaagcagatgaagctccaccctcgccgacacaccaccccggacaagaccccaagctcttccaccgccgccgccgccaaggcctccgtccccgatccgacgccggcgccaccggaggaggaccgcgccaacgacagctcgttcaacccgttcgcgtcgccgacctccgtgctccggtacgcggcagcggacgaggtgaccgcgccatccttcgagcacctcctcgtcgagctgggcgacctctcggcgccgccgccttccaccaaggcggcggagttcgactggctgccgtggtgggaaggggaggacttcgtgacggcggggctgacggcgagcaacgccgtcagcgtgaaatgacgccgctgcccccctccacccatttcgcgctctcggggcgggaaaagttggcgggagacggcgcatcagcagcaaccagcagcaatgttattactactagtattatattaattttattattattatttcgtggcagtaaaaaaaaacccagcggagtttgtactccctagtgaagtgagcagtagtagtaaatggtggtggcgtggggcccaaggcgggcgctcgctttgtgcgtgagctgccttgaatggcacgtctcccgcgtggaaacggaacagtgtaattgcgtggcagatatttattttttctttctttt

SEQ ID NO: 2412 - protein, 281 aa, Oryza sativa (japonica cultivar-group)
  G4292,AP2 domain coordinates 95-157
MRPPAMSPADSLAAGRSRRVGASMPRPKRVRVYFVDADATDTDSSGDERSRPRVREVIDIDVGAASPAPAPKHPRRLVPTATAALARRRAGMAASRRFRGVRRRPWGRFSAEIRDPSLQKRLWLGTFDTAEEAAAVYDDAALRIKGSHAVTNFPSDSDTPSAKAKQMKLHPRRHTTPDKTPSSSTAAAAKASVPDPTPAPPEEDRANDSSFNPFASPTSVLRYAAADEVTAPSFEHLLVELGDLSAPPPSTKAAEFDWLPWWEGEDFVTAGLTASNAVSVK

SEQ ID NO: 2413 - DNA, 882 bp, Oryza sativa (japonica cultivar-group)
  G4293,family:AP2
atgggtggggggaggaggaggaggagcgcggcgatggcgatggagggggaggtggagggtggtgggaggaggcgggtggtgcggatcatcttccgcgacgaggacgcgacggattcgtcgagcagtgaggaggagggggagggggaggtggtggcggcgaggcgggtggtggtgaagcggacgcggctgcggtgccaggaggtggagaggaggttcaccggcgtgcggcggcggccgtgggggaggtgggcggcggagatccgcgaccccaaggagaacgggcggcgcgtgtggctcggcaccttcgacaccgccgaggccgccgccgccgcctacgacgacgcctgcctccgcctccgcggccccggcgccgccctcaacctcccctcccgccgctgcgtcgctcccgctccgcctccaccgcctcctccgccgccgccgacggccgaggagaagaagctgctgctgttcccgccgccgctgcctccgaggaagaaggcgatgctattcccgctgccgctgccgccgaggaagaagccgctgctgtacccgccgccgctgccgccgaagaagaagccgctaccaccaccatcaccaccgccacagccgccgctgccggagaaggagaacaccccgctcccgccgctgctgctgcctccaaagaagaagccgcttccgccgccgtcaccgacagcggcagcgaaggaggagcccatcgagctcgagcatgcggcgccgccgccgcctttcgtgccccggccggtgtggcccctcctggccagcggcggcggcgggaagcggaagaagcagtcgggctgcggcggccgcatccccgccctcaacaccgccgccgccgccgtcgaggagaccggccgcgcctga

SEQ ID NO: 2414 - protein, 293 aa, Oryza sativa (japonica cultivar-group)
  G4293,AP2 domain coordinates 69-132
MGGGRRRRSAAMAMEGEVEGGGRRRVVRIIFRDEDATDSSSSEEEGEGEVVAARRVVVKRTRLRCQEVERRFTGVRRRPWGRWAAEIRDPKENGRRVWLGTFDTAEAAAAAYDDACLRLRGPGAALNLPSRRCVAPAPPPPPPPPPPTAEEKKLLLFPPPLPPRKKAMLFPLPLPPRKKPLLYPPPLPPKKKPLPPPSPPPQPPLPEKENTPLPPLLLPPKKKPLPPPSPTAAAKEEPIELEHAAPPPPFVPRPVWPLLASGGGGKRKKQSGCGGRIPALNTAAAAVEETGRA

SEQ ID NO: 2415 - DNA, 732 bp, Oryza sativa (japonica cultivar-group)
  G4294,family:AP2
atgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctga

SEQ ID NO: 2416 - protein, 243 aa, Oryza sativa (japonica cultivar-group)
  G4294,AP2 domain coordinates 5-72
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 2417 - DNA, 1422 bp, Glycine max
  G4306,family:MYB-(R1)R2R3
tacggctgcgagaagacgacagaagggggaagttgaaggggaaagagagaaaagaactagctagctggagtctgagaactctagcatgtactagtactactcctacattcctccatcttcctttgtactattttttttttaaccataaaagcaagagcacaaagatggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagccaagttccaaaagagccactaagccaaaaatcgaacgttctgattccaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttctgaagttttcatgtgacacgttgaacgagggcattattgaatttggcagatagagtagtttaaatggcatggtataacttgaatttgaccgttacaacaaaagggtacgataatttctggtgtggggacagcattatcaccagctgcaagatctagaggcataatccattgacaaagaaactagccagggtaatgcgaaaggctaatgaatgatatgtaatgtacacatgtaatcaagtagtgaaacactgactttctttctttttagtggaaaacagcaatgctctaacatttttgtattttacaaattagagtttaattaggctagagttacttgattgtaatatcaataaatgatgtattatgtgaattattcaaaaaaatttatgcccttgttgagctctcttttctaaaaaagaaaaaaaaaaaaaaaaagaaa

SEQ ID NO: 2418 - protein, 273 aa, Glycine max
  G4306,MYB-(R1)R2R3 domain coordinates 13-115
MVRAPCCEKMGLKKGPWAPEEDQILTSYIDKHGHGNWRALPKQAGLLRCGKSCRLRWINYLRPDIKRGNFTIEEEETIIKLHDMLGNRWSAIAAKLPGRTDNEIKNVWHTNLKKRLLKSDQSKPSSKRATKPKIERSDSNSSIITQSEPDNFNFREMDTITSSACTTSSSDFSSVTVGDSKNIKSEDTESTETMPVIDESFWSEAAIDDETPTMSSSQSLTISNEMRLQYPFANYEETFQQGHHAYDSNFDDGMDFWYDIFTRTNDSIELLEF

SEQ ID NO: 2419 - DNA, 1032 bp, Solanum lycopersicum
  G4307,family:MYB-(R1)R2R3
aaaagatgggtagagctccttgttgtgagaaaatgggattgaagaaaggtccatggactcctcaagaagacaatattctcatatcttacattcaaaataatggacattccaattggcgtgcccttcctaaacttgctggactattgagatgcggaaagagttgcagattgcgatggactaattatttgcgtccagatataaagagaggaaatttcaccaaagaagaagaagacactataatcaagcttcatgaaaatcttggcaatagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcaaaaatggaggaggacatggacttttggtacaatgttttcataaagacaggggatttgccagaattaccagaattttgaggggtctattttgattattatgtaaattttgagattaattagtggtatttctagctaatagttttttcttttttcttttaggaatttttggagttggcaagtttgaaatttcatgtttgtttaatcttgactattatttagagtggaccccaaaaaaataaaaaaataattccaaaaaaaaaaaaaaaaaaaaaaaaaaaaaaaaaaaaaaaaaaaaaaaaaaaaaaaa

SEQ ID NO: 2420 - protein, 265 aa, Solanum lycopersicum
  G4307,MYB-(R1)R2R3 domain coordinates 13-115
MGRAPCCEKMGLKKGPWTPQEDNILISYIQNNGHSNWRALPKLAGLLRCGKSCRLRWTNYLRPDIKRGNFTKEEEDTIIKLHENLGNRWSAIAARLPGRTDNEIKNIWHTNLKKKLKNYQPCQNSKRHSKTSHVSNKGPTTSESSNNSDLSTSTKQHIKIAPNSPQLSSSEMSSVTLVVDDNQMVIIKEEKIESSSSEYFPKIDESFWADELSTENNMIIGHDQEIQVREENVDIFTTSSKMEEDMDFWYNVFIKTGDLPELPEF

SEQ ID NO: 2421 - DNA, 1038 bp, Oryza sativa (japonica cultivar-group)
  G4308,family:MYB-(R1)R2R3
gcatcacacagacgacgcagcatcagcaacacacacacacaccgagcaatcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcgatggcctcctccgcggatcacaacaccacggacagtttcacctcggaggaggagttccagatcgacgacagcttctggtcggagacgctggcaatgacggtggacagcaccgactccgggatggagatgagcggcggcgatcctctcggcgcgggcggtgcctcgccgtcgtcgagcaacgacgacgacatggacgacttctggctcaagctgttcatccaggccggtggcatgcagaatttgccccagatttaatttaggcagagaattggcctcttgggtcgatctcttgttcatttttcttaccaccactattctttgaatctttggagctgtgtaaatctttacaaagcggagagattgatgggaaacgaaagaaggcaatattatcttt

SEQ ID NO: 2422 - protein, 258 aa, Oryza sativa (japonica cultivar-group)
  G4308,MYB-(R1)R2R3 domain coordinates 13-115
MGRAPCCEKMGLKRGPWTAEEDRILVAHIERHGHSNWRALPRQAGLLRCGKSCRLRWINYLRPDIKRGNFTREEEDAIIHLHDLLGNRWSAIAARLPGRTDNEIKNVWHTHLKKRLEPKPSSGREAAAPKRKATKKAAAVAVAIDVPTTVPVSPEQSLSTTTTSAATTEEYSYSMASSADHNTTDSFTSEEEFQIDDSFWSETLAMTVDSTDSGMEMSGGDPLGAGGASPSSSNDDDMDDFWLKLFIQAGGMQNLPQI

SEQ ID NO: 2423 - DNA, 1084 bp, Zea mays
  G4309,family:MYB-(R1)R2R3
gtgtccacacagcaaaccacccgcgctccgccaatccagagagccagccagcccgagctcacacagcagcgagctcggtcttctcgccaggacacgaacacgaccccagcaggcggcaggcaagccacgctctctcgacggacggacgttaatcgagacatggggcgctctccgtgctgcgagaagatggggctgaagaggggtccgtggacggccgaggaggacaggattctggtggcgcacgtcgagcgccacggccacagcaactggcgcgcgctgcccaagcaggcgggcctgctccgctgcggcaagagctgccgcctccgctggatcaactacctgcgccccgacatcaagcgcggcaacttcagccgggaggaggaggacgccatcatacagctccaccaaatgctcggcaacagatggtcgacaatcgctgccaggctgccggggaggacggacaacgagatcaagaacgtctggcacacccacctcaagaagcgcctggagccacagccagccagccagcaggcgcccaagcgcaagcccacgaagaagcagcagccgcagccggagcccgagcccgtaacgacgctcgaggggccggccggggccgtgccgccggtgtcgccggagcggtcactctccacgacgacgtcgaccaccaccagcaccgcggactactcggccgcctcgtcgctggagaacgcgggcgacagcttcacgtcggaggaggactactaccagatcgacgacagcttctggtccgagacgctggcgatgacgacgacggtggacagcttccagtccggggtgcagcaggcggagggcagcttccgcgcgtcggcggcggcgccgtcgtcgaccaacgacgacatggacttctggctcaagctgttcatgcaggccagcgacatgcagaatttgccccagattatttaggcgggaaacggacctagacggtttgttatctctcggctgatgatgatattctttggcgcgcgctcacgattctttgaatctttgttctgctccgttttcggtggatgtatatatcccactgaaaccttgtgaagcggaaagc

SEQ ID NO: 2424 - protein, 260 aa, Zea mays
  G4309,MYB-(R1)R2R3 domain coordinates 13-115
MGRSPCCEKMGLKRGPWTAEEDRILVAHVERHGHSNWRALPKQAGLLRCGKSCRLRWINYLRPDIKRGNFSREEEDAIIQLHQMLGNRWSTIAARLPGRTDNEIKNVWHTHLKKRLEPQPASQQAPKRKPTKKQQPQPEPEPVTTLEGPAGAVPPVSPERSLSTTTSTTTSTADYSAASSLENAGDSFTSEEDYYQIDDSFWSETLAMTTTVDSFQSGVQQAEGSFRASAAAPSSTNDDMDFWLKLFMQASDMQNLPQII

SEQ ID NO: 2425 - DNA, 1344 bp, Zea mays
  G4310,family:MYB-(R1)R2R3
ccacgcgtccgcccacgcgtccgcccacgcgtccgggacagtgctccctcccgtccccaaagacaaacaggcgagcagcaaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcgggggcggcggagccaggaaggcgacggccgacgccgtcgtcgtcccggccaccgctgcgccggcgtcgcccgaacggtccgcggcctcgtcgtcggtgaccgagtcgtccatgacggagcaggagcaggagcacggcaacacggggagctcgcccgcgttccccaaggaggagagcttcaccacctcctcctcggacgccgaggagttccagttcgacgacagcttctggtccgagacgctgtcgatgccgctggacagcctcgacgacgtcgtccccatggagccctccgacgacgcgttcggcgacgtcgacgtcgacgtggccgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttctctctctctctctctctctgcacgtcttgcatcagaggggacggacaaggacagcatcagctgattaacagagaaggaaatcaggcaggaacaacgcgacacgccgttgcaacttggatcgatcttgtttgccttcttgttgtatagatactagaatccatccaagtctatgcgttctgagaacagaagcacgctgtgctgtgcatgcagattcccatgtatgtacagtagccacggccgccgccagaacagaaatggatccggcctcttccaaattccaaaaaaaaaaaaaaaaaaaaaaaaaaaag

SEQ ID NO: 2426 - protein, 289 aa, Zea mays
  G4310,MYB-(R1)R2R3 domain coordinates 13-115
MGRAPCCEKMGLKKGPWTPEEDKVLVAHIQSFGHSNWRALPKQAGLLRCGKSCRLRWINYLRPDIKRGNFSKEEEDAIISLHEQLGNRWSAIAARLPGRTDNEIKNVWHTHLKKRLDPTKQEQQQQHGTTPVAGAGKKHRPAAAAKRGGGGARKATADAVVVPATAAPASPERSAASSSVTESSMTEQEQEHGNTGSSPAFPKEESFTTSSSDAEEFQFDDSFWSETLSMPLDSLDDVVPMEPSDDAFGDVDVDVAAASSSSVGADGDLDYWLRVFMESGDAHPELPQI

SEQ ID NO: 2427 - DNA, 1848 bp, Glycine max
  G4311,family:HLH/MYC
tgtcagaagagaagaactgagacgaagcaaaagctgaaaagcttaaactggcgaaatataaagacccatccaaaagcactatacgaaatccaatcccaccactctcttttttcttcttccttttcgtgctctctctcaaattcaacacgagagacacaaaacaaaacattctcgggaagcgtaaccgcccagaattccgaccattttcacagaccttgttttctgctcttgatgtttttcaccccccaaatgtggcaataaaaaacgggtggcttaatttgacacaatcggtggttattgcaaagttgagatggcaggtaatagtggttcagaggggttgggcgatgatttcttcgaacagatcttagcagtgcctgaagccggcacagtgggaatgttgcaattggggtccacaactggtggtttcagaggagcttctgggttaatgcctctgggcttgaatttggaacaagctgccttcctaagacaccaagttaacgttgacgacgacgttgttcatgttaatgttgatgatgccaccatccaccaacatcacctcactctccataacaacaacacctcctcatcaccctcttccactgcaccaatcaccgatagggattctatgcatatgaggggcttattttccgcgtttggacaactgcatactcctatccgccccacgctgccattgcctccaccacctcgtcagccacaactccacctccaccatcataaccaacagtttcagggccaggcagctgcagctccagcgtcaatggctgctatgccacaaccacctgggatccgccctcgtgtgagagcaagaagagggcaagctacagatcctcacagtattgctgagcggttgcgtcgtgaaagaatcgctgaaagaatgaaggcattgcaggaattagttcccagcatcaataagacggacagagcggcgatgcttgatgaaattgttgactatgtgaagttcctaaggctccaggttaaggtcctgagcatgagtagactgggaggagctggtgcagttgctcagcttgttgctgatgttcccctttctgcagtggagggggatcaggacatagaaggtgtatccaatgagcaagcctgggacaagtggtccaatgatggcacagaacaacaggtggctaagcttatggaagaagatgttggagcagctatgcaatttcttcagtccaaggcactttgtatcatgccaatatctctagcctcatccattttccgcatgcctcaatcggaagcatcaacaggcatcaaacctgaatctaacagtcactgatattagtgatagaaccgaaacaaaattaaagtatcatgacagacattacataattaaatttcttcatcctttatgacaagggtattctactttcttgtataatttaattttcctgattggatggagaaggatctagtcggtgcagcagctggttcactcttctcaagttttgtcaaagaaggagtaattgttattcctattaagtaaaatcggaggagccaagcaaatgtccttttcatggtgaagattaatattttcaatggccttattcaagtttttcttgcaaatatctgtggtggggttggtggtggatgaccaaaatatttgtagtggaacctcttttcttggttttgtatttttagtcagtggggagtgggaccatttaaaaggaaaggatggttacgaatgatgtatcgggagaaaactttaatacaagttgaattataatatggttagttaccttgtaaagatgttttggaagaccatctgaccattggaaaagctaaagatattttaaaataatcacacattttgagtaa

SEQ ID NO: 2428 - protein, 332 aa, Glycine max
  G4311,HLH/MYC domain coordinates 173-230
MAGNSGSEGLGDDFFEQILAVPEAGTVGMLQLGSTTGGFRGASGLMPLGLNLEQAAFLRHQVNVDDDVVHVNVDDATIHQHHLTLHNNNTSSSPSSTAPITDRDSMHMRGLFSAFGQLHTPIRPTLPLPPPPRQPQLHLHHHNQQFQGQAAAAPASMAAMPQPPGIRPRVRARRGQATDPHSIAERLRRERIAERMKALQELVPSINKTDRAAMLDEIVDYVKFLRLQVKVLSMSRLGGAGAVAQLVADVPLSAVEGDQDIEGVSNEQAWDKWSNDGTEQQVAKLMEEDVGAAMQFLQSKALCIMPISLASSIFRMPQSEASTGIKPESNSH

SEQ ID NO: 2429 - DNA, 1760 bp, Glycine max
  G4312,family:HLH/MYC
gaactaccccccacgcgtccgtgcaaaaccgaaaacaaaaaaccaaacccaaacgaaaccgaccaaaatctcgccagcgtccctttccgcttcatgtagtttctgcgttcccaactccttctcccgactctaccctgactcgcccgagtccacactcaaacccgcgctcatggcaaataacccttccgacgctcccgccgatgacttccttgaacaaatcctcggcctcccgaacttcgcttccgccgactccggcctttccgctgccgatgtcggcctcgccggtgcggccactcaggctccgatgatgctgcaactcaactccgccgacgccaacgctcacctcgccggcgccgccttccacgcgcccgtgtatcagctagggctgagcttggaccagggcaaaggtgggttcatgaagcccgaggaagcctccgctagcggaaagcgctttcgcgacgacgtcgttgataatagagctaagaatgtttttcatgggcaacccatgcctactactatgcctgctgctccacatcctccagcaatacgtcctagggtgcgggccagaagaggacaggctacagatccacacagcatagctgaacgattacgcagagaaagaatagcagaaagaatcagggcattgcaagaactggttccaagtgtcaacaagacagatagagctgccatgttagatgaaattgtggattatgtcaagttcttaaggcttcaagtgaaggttttgagcatgagtagactgggtggagccggtgcagtggcaccactggtaactgacatcccattatcatcagtcgaggaagaaggtggtgaaggtgcgcgaaaccggccagcttgggacaagtggtcaaatgatggcacagaaagacaggtagctaagcttatggaagaaaacgttggggctgccatgcagtttcttcaatcaaaggctctctgcatcatgcccatctcactggcatcggcaatataccagtcacaaccaccggacacttctagcatagtcaagcctgaaactagtcctccttcatagacctaattctcatgttgcacaatctattattattggtcccatcccaggctcactaatacttgctgggacccacgcctaacgcgttatttgtctgttccaaatcccccccccataaataagtcattggcaagcatcaagttgcaatcaaagtcagatgccataattcttccttttttgcctttctttcagcttttgtcaatacagggttcgatatcaatgccttggaaaagacaagcaaacccctatatcatgtcttgccgtatttcaagtagagaggaagacattgtcaaaagttcaattgatatgcgcttcttttctagtgtcaaatgggtgggggtagtggaccatgatgtaagcgcttttatagtggggcttagtttttgtagtgggctgtgggaccttctaaaaggttagagtgtggtgtgtgtatatttttaatagtagtgaagctgaaatggacaatagttgctttaacaatgctgggctttgccgagtcctgcaaaaaatgatgatgctttttgtttgtttagggcgtgcgtgagttgtttactcaaaagtaattggacgacttttccctattcttgtgaatcattaatagattttgattcatcggatggaaatggaagctcctttcacgcaatgacccaatccttgtcaatcagtaagctctaaccttattcaattcaagtgacaagaagtcttctctcagttg

SEQ ID NO: 2430 - protein, 292 aa, Glycine max
  G4312,HLH/MYC domain coordinates 133-190
MANNPSDAPADDFLEQILGLPNFASADSGLSAADVGLAGAATQAPMMLQLNSADANAHLAGAAFHAPVYQLGLSLDQGKGGFMKPEEASASGKRFRDDVVDNRAKNVFHGQPMPTTMPAAPHPPAIRPRVRARRGQATDPHSIAERLRRERIAERIRALQELVPSVNKTDRAAMLDEIVDYVKFLRLQVKVLSMSRLGGAGAVAPLVTDIPLSSVEEEGGEGARNRPAWDKWSNDGTERQVAKLMEENVGAAMQFLQSKALCIMPISLASAIYQSQPPDTSSIVKPETSPPS

SEQ ID NO: 2431 - DNA, 1274 bp, Zea mays
  G4313,family:HLH/MYC
cattcacttccccagcagagcaggcaaaccgctcccagtcccagtctctcacctgaggtgactggcgtctcttgtcgcgagccgccagaagcttcggcccctgacgcgtgggggccccgtccgcccccgcccccgtccccacgttgccggccatggcggggcagccaccgccgtccggggcctccgaggacgacttcctcgagcacttcttcgccttcccctccgcggcctccgccggcgctgccgggggccacgcgggcgccggtgttggcggggaccaccccttccccctcgccctcagcctcgacgccgccgccgaggccaagccggaccgtgatcccgtgcagctcgccggcctcttcccgccggtgttcgctggcgccggcggcgtgcaccagccgcacctccgcggcccaccgcctccgcagatgttccaggcgcagccgaagccgggcgagggaggcatggcgccgcagccgccagccccgcggcccaaggtgcgcgcgcggcgggggcaggccaccgatccccacagtattgcggagaggctaaggagagagagaattgcagaaaggatgagggcattgcaggaattagtccccaacacaaacaagacagatagggcagccatgctagatgagatccttgattatgtgaagtttcttaggcttcaagtaaaggttctgagtatgagcagactgggcggtgctggcgcggttgcgcagctggttgctgatattccactctcagttaagggcgaggcaggcgacggcgggggggcgccgcagcagcagcagcagcagcacgtgtgggagaagtggtcgacggacggcacggagaagcaggtggcgaagctgatggaggaggacatcggggcggcaatgcagttcctccagtccaaggcgctgtgcatgatgccggtctcgctcgcgatggcgatctacgacacccagcaccccctggacggccacggccactcgctgaagcccgagcccaacgcgtcatcctagtacagtaacgtcgtccttagcgtgccttccaattccaacacccaccccccttctccctaaaaagtactgttaggcgccgatattatccggaagaaaaaaagaagtgtatgatataccgagcgtgcgtttccagtgtgctgacccgtgggataggaaaggaccgaaaattgttggtatatgatgattatgtagcctcctgtttgcctgttctgtttcaaaaaaaaaaaaaaaacatgcatccaggttccaaaaaaaagggcgggc

SEQ ID NO: 2432 - protein, 285 aa, Zea mays
  G4313,HLH/MYC domain coordinates 119-176
MAGQPPPSGASEDDFLEHFFAFPSAASAGAAGGHAGAGVGGDHPFPLALSLDAAAEAKPDRDPVQLAGLFPPVFAGAGGVHQPHLRGPPPPQMFQAQPKPGEGGMAPQPPAPRPKVRARRGQATDPHSIAERLRRERIAERMRALQELVPNTNKTDRAAMLDEILDYVKFLRLQVKVLSMSRLGGAGAVAQLVADIPLSVKGEAGDGGGAPQQQQQQHVWEKWSTDGTEKQVAKLMEEDIGAAMQFLQSKALCMMPVSLAMAIYDTQHPLDGHGHSLKPEPNASS

SEQ ID NO: 2433 - DNA, 703 bp, Solanum tuberosum
  G4328,family:AP2
tcttcatcttcttctaaaggaaaaaaagtcatgcaattagagaaagaaaatggcaaggatagtaatgatttgatcaaatatcgaggcgttcggaagcgtacgtggggtaaatttgcagcggagatacgtgacccaacgagacaaggcgctcgccaatggctcgggacgtttgatacggccgaggacgcggcgagggcctatgacaaggcagcatttaacctaaggggacatcttgctactttgaatttcccaaatgagtattattctaagcttaatgatccacattattataattatcgtacttcattaaatgttaatactccaagtagaagtatagagaggggaatctcatcaattggtcatcaagacaaagatatcattgagtttgagtatcttgatgaaagtgtgctagaggaacttcttggagcagaagacccaaaaaagatgataagaaagtgaggtttatatgttttgtaatttttaaattttaagttatcatcgtgtcgagatgaacctttattactggaggaaaggaaaaacgatgaattcctatatagagtatctaggaaaaaaccttcgagtttcccttcatctttgttttcttcttattcatcatcgttgtcgtttttaatttccttttttataaacatatttggtattaattaagaacttatttgtataatataatgtttgccttaagagt

SEQ ID NO: 2434 - protein, 142 aa, Solanum tuberosum
  G4328,AP2 domain coordinates 13-77
MQLEKENGKDSNDLIKYRGVRKRTWGKFAAEIRDPTRQGARQWLGTFDTAEDAARAYDKAAFNLRGHLATLNFPNEYYSKLNDPHYYNYRTSLNVNTPSRSIERGISSIGHQDKDIIEFEYLDESVLEELLGAEDPKKMIRK

SEQ ID NO: 2435 - DNA, 621 bp, Petunia x hybrida
  G4329,family:AP2
catggaacaagagcctagccagggaagaaacatgaaggacaacaaaaatagtggtggcggagagatcaaatatcgaggcgtccgaaggcggccgtgggggaagtttgcggcggagattcgcgactcggctcgacagggtgcacgtgtatggttagggacatataacacagctgaagaagctgcaagagcttatgacagggcagcttattccatgaggggtcatctagctatacttaattttcctgaagaatataatttacctagtagctcttctcatttctatactggttcttcttcatcatcaaggcaagttcttgaatttgaatgcttggatgattcgttgctggaggaacttcttgattgtgatgaggaatccaacaagaggaaataaagatcctactgtaatttcactttcaaaaaattgtgatttattgccttaaaatcatctaattcttgggatggggttgtgactttttttctttttattatttcaccttttttcctttttctttctttgggtttcggtttttgaacggagctatttgcactctgctgatgcaatgcttgtaacactattgtactatttggtgatgaacatgctgaagggtcaagaagaaaggc

SEQ ID NO: 2436 - protein, 129 aa, Petunia x hybrida
  G4329,AP2 domain coordinates 20-84
MEQEPSQGRNMKDNKNSGGGEIKYRGVRRRPWGKFAAEIRDSARQGARVWLGTYNTAEEAARAYDRAAYSMRGHLAILNFPEEYNLPSSSSHFYTGSSSSSRQVLEFECLDDSLLEELLDCDEESNKRK

SEQ ID NO: 2437 - DNA, 570 bp, Populus trichocarpa x Populus nigra
  G4330,family:AP2
agacgttcgttactgggctcctcttcacttcaaacacagaatggaaacacatcaaggagagaagaacacaaagaagcaagagaaaggaaggggggagaatgcgtataggggaattcgcaggcgaccttggggtaagtttgctgccgagatacgtgacccaacaaagaatggggcacgtcgttggctaggaacatatgacacggcggaggaggcggctcgggcatatgaccgagctgcttttgccttccggggtcatttagccattctcaatttcccgaatgaataccaacatcaggatccaagctctgccatgtcatttgcttcttcatcttcattctccactgccaatcctgtgaattatggccatgaagtttcctctcctggcggacaagaagttatagagttcgagtatttggataacaaattgttggaggagttgctgggaacgaatgatcccagcaggcagcattaggcccattgatgaatgtggattgtcactttgtcatgtcacccttcaatgcaattcttttattttgtccgttgtttgaatccaaaaaaaaaaaaaaaaaa

SEQ ID NO: 2438 - protein, 143 aa, Populus trichocarpa x Populus nigra
  G4330,AP2 domain coordinates 18-82
METHQGEKNTKKQEKGRGENAYRGIRRRPWGKFAAEIRDPTKNGARRWLGTYDTAEEAARAYDRAAFAFRGHLAILNFPNEYQHQDPSSAMSFASSSSFSTANPVNYGHEVSSPGGQEVIEFEYLDNKLLEELLGTNDPSRQH

SEQ ID NO: 2439 - DNA, 678 bp, Zea mays
  G4369,family:HB
atggggtccacttctccttcaggcctggagctcaccatggctgtcccgggcctcagctcctcctctggctcagaggggtttggatgcaacaacaacaacgggagcgggaacgggaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcaccatgtgcccgcgctgcgagcgcatcaccgccgcaacggccgcgcgcaccccacgcccgccgcccgccgcgagccccttccacccgcgccgcccgtccgcggcgttttag

SEQ ID NO: 2440 - protein, 225 aa, Zea mays
  G4369,HB domain coordinates 81-141
MGSTSPSGLELTMAVPGLSSSSGSEGFGCNNNNGSGNGNNMRDLDMNQPASGGEEEEFPMGSVEEEEDERGGAGGPHRAKKLRLSKEQSRLLEESFRLNHTLTPKQKEALAVKLKLRPRQVEVWFQNRRARTKLKQTELECEYLKRCFGSLTEENRRLQREVEELRAMRVAPPTVLSPHTRQPLPASALTMCPRCERITAATAARTPRPPPAASPFHPRRPSAAF

SEQ ID NO: 2441 - DNA, 669 bp, Zea mays
  G4370,family:HB
atgggggccacttctccttcaggcctggagctcaccatggctgtccccggcctcagctcctcctctggctcagaggggtttgtttgcaacaacaatatcagcaacaacggtggcgggaacatgagggacctggacatgaaccagccggcgagcggcggcgaggaggaggatttcctgatgggcggcgtggaagaggacgaggaggagcggggcgccggcggaccgcaccgcccaaagaagctccgcctctccaaggagcagtcccgcctcctcgaggagagcttccgcctcaaccacaccctctcaccgaagcaaaaggaggccttggcgatcaaactgaagctgcggcccaggcaggtggaggtctggtttcagaaccgcagggcaaggactaagctgaagcacacggagatggagtgcgagtacctgaaacgctgcttcggctcgctgacggaggagaaccgccgcctgcagcgggaggtggaggagctgagggcgatgcgcatggcgccgcccacggtgctctcgccgcacacacgccagccactcccggcgtccgcgctcaccatgtgcccccgctgcgagcgcgtcaccgctgccacctgcccgcggatcacccgcccggccgcctcgccgttccaccctcgccgcccctcagcggcgttttag

SEQ ID NO: 2442 - protein, 222 aa, Zea mays
  G4370,HB domain coordinates 80-140
MGATSPSGLELTMAVPGLSSSSGSEGFVCNNNISNNGGGNMRDLDMNQPASGGEEEDFLMGGVEEDEEERGAGGPHRPKKLRLSKEQSRLLEESFRLNHTLSPKQKEALAIKLKLRPRQVEVWFQNRRARTKLKHTEMECEYLKRCFGSLTEENRRLQREVEELRAMRMAPPTVLSPHTRQPLPASALTMCPRCERVTAATCPRITRPAASPFHPRRPSAAF

SEQ ID NO: 2443 - DNA, 642 bp, Glycine max
  G4371,family:HB
atggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcttctccttgaagaaagctttagacaaaaccacacgttgaacccaaagcagaaagagtctttggcaatgcaactgaagctgcgaccaaggcaagtggaggtgtggtttcagaaccgtagggccaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttag

SEQ ID NO: 2444 - protein, 213 aa, Glycine max
  G4371,HB domain coordinates 62-122
MAVLPSSSSSLELTISVPGFASSPTLLPSSSVKELDINQVPLEEDWMASNMEDEEESSNGEPPRKKLRLTKEQSLLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 2445 - DNA, 2821 bp, Arabidopsis thaliana
  G438,family:HB
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 2446 - protein, 842 aa, Arabidopsis thaliana
  G438,HB domain coordinates 22-85
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 2447 - DNA, 971 bp, Arabidopsis thaliana
  G448,family:IAA
tttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctctttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 2448 - protein, 229 aa, Arabidopsis thaliana
  G448,IAA domain coordinates 11-20,83-95,111-128,180-214
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 2449 - DNA, 899 bp, Arabidopsis thaliana
  G455,family:IAA
tttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattt

SEQ ID NO: 2450 - protein, 243 aa, Arabidopsis thaliana
  G455,IAA domain coordinates 11-19,84-95,126-142,194-227
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 2451 - DNA, 1169 bp, Arabidopsis thaliana
  G456,family:IAA
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 2452 - protein, 236 aa, Arabidopsis thaliana
  G456,IAA domain coordinates 7-14,71-81,120-153,185-221
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 2453 - DNA, 822 bp, Glycine max
  G4570,family:AT-hook
atggcgaatcgttggtgggccgggagcgcgacggtgaagcccagtgaacaagataacggtgacaacaacggtactcccaccaacagtgggaacagtaacaccaaagttaacgcggttctcgaggacgacgcaaacaccaacgagcgcgacggcgaagagcagaccctcagcggcgggcggcggccgcgtggcaggccgccagggtcaaagaacaagccaaagccgccggtggtgataacgaaagagagccccaacgcgctctgcagccacatccttgagatcagcgacggcagcgacgtggctgagtgcattgctatcttcgccacgcgccgccaccgcggcgtctcagtcctcagcggcaacggtttcgtcaccaacgtcacgctccggcagccggcggcccctggaggggtcatcaccctccaggggcggttcgagattctctccctctccggcgcgttcctgccggcgccttcgccgccggaggccaccggactcaccgtgtacctcgccggcgggcaggggcaggtggtcggaggaagcgtggtgggaccccttgtcacctcggggccggtgattgttgttgctgctactttcgctaatgctacctatgaaaggttgcctttggaggatgaaaaaggtgaagaggacatgcaagaggtgaatgaaggtgatggtggtggaacatcaccaccacaaccaccaccaccaccaccaccaccttcacaaggtgaacaacaggtttcaatgccggtgtataatttggtgcctaataatggtgatgtgttttgggggcctccatcttcaccttctaattattga

SEQ ID NO: 2454 - protein, 273 aa, Glycine max
  G4570,AT-hook domain coordinates 60-213
MANRWWAGSATVKPSEQDNGDNNGTPTNSGNSNTKVNAVLEDDANTNERDGEEQTLSGGRRPRGRPPGSKNKPKPPVVITKESPNALCSHILEISDGSDVAECIAIFATRRHRGVSVLSGNGFVTNVTLRQPAAPGGVITLQGRFEILSLSGAFLPAPSPPEATGLTVYLAGGQGQVVGGSVVGPLVTSGPVIVVAATFANATYERLPLEDEKGEEDMQEVNEGDGGGTSPPQPPPPPPPPSQGEQQVSMPVYNLVPNNGDVFWGPPSSPSNY

SEQ ID NO: 2455 - DNA, 818 bp, Arabidopsis thaliana
  G46,family:AP2
ttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttccaagaaaaaaaaaaaaaaaaaa

SEQ ID NO: 2456 - protein, 207 aa, Arabidopsis thaliana
  G46,AP2 domain coordinates 107-175
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 2457 - DNA, 705 bp, Solanum lycopersicum
  G4626,family:AP2
atggatcaacagttaccaccgacgaacttcccggtagattttccggtgtatcgccggaattcaagcttcagtcgtctaattccctgtttaactgaaaaatggggagatttaccactaaaagtcgatgattccgaagatatggtaatttacggtctattaaaagacgctctaagcgtcggatggtcgccgtttaatttcaccgccggcgaagtaaaatcggagccgagagaagaaattgaatcgtcgcttgaattttcaccttctccggcggagaccacggcagctccggcgactgaaacaccgaaaggaagacattatagaggcgttaaacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttgaatgtcaaattgaacaattgacaggtgtccatcaactattggtcatttag

SEQ ID NO: 2458 - protein, 234 aa, Solanum lycopersicum
  G4626,AP2 domain coordinates 102-166
MDQQLPPTNFPVDFPVYRRNSSFSRLIPCLTEKWGDLPLKVDDSEDMVIYGLLKDALSVGWSPFNFTAGEVKSEPREEIESSLEFSPSPAETTAAPATETPKGRHYRGVKQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVECQIEQLTGVHQLLVI

SEQ ID NO: 2459 - DNA, 612 bp, Oryza sativa (japonica cultivar-group)
  G4627,family:bZIP
atggcggcgcaggagcaggagcaggagaagcagcaggtgaagacgagcacgacgagctcgctgccgtcgagcagcgagcgctcctccagctcagcccccaacaacctcaaggaaggaggaggggtggagagcgacgaggagatacggcgggtgccggagatgggagggggcggcgggtcggcgtcgtcgggggcgggggcggacgagcggcaggggaaggaggacgggaagcagcagggtggtggcggcggcggggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccagatactcaagaacacgacggcgcacgccggcaagaggggcggcggcggcggaggcaagggcggcgatggcggcggcggcgggaagaagcaccatttcaccaagagctag

SEQ ID NO: 2460 - protein, 203 aa, Oryza sativa (japonica cultivar-group)
  G4627,bZIP domain coordinates 43-55,100-179
MAAQEQEQEKQQVKTSTTSSLPSSSERSSSSAPNNLKEGGGVESDEEIRRVPEMGGGGGSASSGAGADERQGKEDGKQQGGGGGGAAAAGGGQEQAPPARKRGRSAGDKEQNRLKRLLRNRVSAQQARERKKAYMTELEAKAKDLELRNAELEQRVSTLQNENNTLRQILKNTTAHAGKRGGGGGGKGGDGGGGGKKHHFTKS

SEQ ID NO: 2461 - DNA, 2434 bp, Oryza sativa (japonica cultivar-group)
  G4628,family:RING/C3HC4
ttattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcgggggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtcttgaagaaaatgtcagctcgccaaattgcgaagacagcatcaccgatagaccaatttcgatatgcactgcaacagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgagattcaaactgacctacagtacatcaaagaagatataagtgctgtggagagacataggttagaattatatcgaacaaaagaaaggtactcaatgaagctccgcatgcttttggatgaacctgctgcatcaaagatgtggccttcacctatggataaacctagtggtctctttcttcccaactctcggggaccacttagtacatcaaatccagggggtttacagaataagaagcttgacttgaaaggtcaaattagtcatcaaggatttcaaaggagagatgttctcacttgctcggatcctcctagtgcccctattcaatcaggcaacgttattgctcggaagaggcgagttcaagctcagtttaacgagcttcaagaatactatcttcaaagacggcgtaccggagcacaatcacgtaggctggaggaaagagacatagtaacaataaataaagaaggttatcatgcaggacttgaggatttccagtctgtgctaacaacattcacacgatatagtcgcttgcgtgtaattgcggagctaagacatggagatctgtttcactctgcaaatatcgtatcaagtatcgaatttgaccgtgatgatgagctatttgctactgctggagtctcaaagcgcatcaaagtcttcgagttttctacagttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccagagtgtgatggagtatgaagaacatgaaaagagagcatggagtgttgatttttctcgaacagaaccctcgatgctagtatctgggagtgatgattgcaaggtcaaagtgtggtgcacaaagcaagaagcaagtgccatcaatattgatatgaaggccaatatttgctctgtcaaatataatcctgggtcgagccactatgttgcagtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtaaggacattcagagggcacaagaatgaaaagaactttgttgggctgtctgtaaataacgagtacattgcctgcgggagtgaaacgaatgaggtttttgtttaccacaaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggttgcataaaaaaaaaaaaaaaa

SEQ ID NO: 2462 - protein, 685 aa, Oryza sativa (japonica cultivar-group)
  G4628,RING/C3HC4 domain coordinates 59-101,134-217,384-680
MGDSTVAGALVPSVPKQEQAPSGDASTAALAVAGEGEEDAGARASAGGNGEAAADRDLLCPICMAVIKDAFLTACGHSFCYMCIVTHLSHKSDCPCCGNYLTKAQLYPNFLLDKVLKKMSARQIAKTASPIDQFRYALQQGNDMAVKELDSLMTLIAEKKRHMEQQESETNMQILLVFLHCLRKQKLEELNEIQTDLQYIKEDISAVERHRLELYRTKERYSMKLRMLLDEPAASKMWPSPMDKPSGLFLPNSRGPLSTSNPGGLQNKKLDLKGQISHQGFQRRDVLTCSDPPSAPIQSGNVIARKRRVQAQFNELQEYYLQRRRTGAQSRRLEERDIVTINKEGYHAGLEDFQSVLTTFTRYSRLRVIAELRHGDLFHSANIVSSIEFDRDDELFATAGVSKRIKVFEFSTVVNEPSDVHCPVVEMATRSKLSCLSWNKYSKNVIASSDYEGIVTVWDVQTRQSVMEYEEHEKRAWSVDFSRTEPSMLVSGSDDCKVKVWCTKQEASAINIDMKANICSVKYNPGSSHYVAVGSADHHIHYFDLRNPSAPVHVFGGHKKAVSYVKFLSTNELASASTDSTLRLWDVKENCPVRTFRGHKNEKNFVGLSVNNEYIACGSETNEVFVYHKAISKPAANHRFVSSDLDDADDDPGSYFISAVCWKSDSPTMLTANSQGTIKVLVLAP

SEQ ID NO: 2463 - DNA, 2871 bp, Pisum sativum
  G4629,family:RING/C3HC4
ggcacgaggcggccgctcctggctcaggatgaacgctggcggcatgctttacacatgcaagtcggacgggaagtggtgtttccagtggcgaacgggtgagtaacgcgtaaaaacctgcccttgggagggggacaacagctggaaacggctgctaataccccgtaggctgaggagcgaaaggaggaatccgcccaaggaggggctcgcgtctgattagctagttggtgaggtaataccttaccaaggcaatgatcagtacctggtccgaaaggatgatcagccacactggggactgagacaaggtccaaactcctacgggaggcagcagtggggaattttccgcaatgggcgaaagcctgacggagcaatgccccgtggaggtagaggcccctgggtcatgaacttcttttcccggagaagaaaaaatgacggtatccggggaataagcatcggctaactctgtgccagcagccgcggtaagacagaggatgcaagcgttatccggaatgattgggcgtaaagcgtctgtaggtggctttttaagttcgctgtcaaataccagggctcaaccctggacaggtggtgaaaaccacatccactctaaacctcaccatggaagagcactcagtaggacctctagtccctgcagtagtgaaaccagaaccttccaaaaacttctccaccgacaccaccgccgccggcacgtttctcctggttcccaccatgtctgacctagataaggacttcctctgcccgatttgcatgcagatcatcaaagacgcgtttctcacagcctgtggtcatagcttctgctacatgtgtatcatcactcatctccgtaacaaaagcgattgtccttgctgtggtcattacctcaccaacagtaatttgttcccgaacttcctgctcgataagctactaaaaaagacatcagatcgtcaaatatcaaagacggcttctcctgtggagcatttccggcaggcagtacaaaagggctgtgaagtgacaatgaaggagctcgacacccttttgttactccttactgagaagaaaagaaaaatggaacaagaagaagctgagagaaatatgcaaatattgttagatttcttgcattgcctacgcaagcaaaaagttgatgagttgaaggaggtgcaaactgatctccagttcataaaggaggacattggtgctgtggagaaacatagaatggatttgtatcgtgctcgagacaggtactctgtgaaattgcggatgcttgacgattctggtggaagaaaatcacggcattcatcaatggacttgaatagcagtggcctcgcatctagtcctttaaatcttcgaggagggttatcttcagggagccatactaagaaaaatgatggaaagtcacaaatcagctctcatgggcatggaattcagagaagagatcccatcactggatcagattcacagtatataaatcaatcgggtcttgctctagttagaaagaaaagggtgcatacacagttcaatgacctacaagaatgttatctacaaaaacgacggcaagcagcagataagccacatggccaacaggaaagggatacaaatttcataagtcgagaaggttatagctgtggtcttgatgattttcagtcagtcttgacaactttcacacgctacagccgattgagagtcattgcagaaataagacacggggatatatttcattcagccaacattgtttcaagcatagagtttgaccgtgatgatgatttgtttgctactgctggagtttcccgacgtatcaaagtttttgatttttctgcggtcgtgaatgaacccacagatgctcattgtcctgttgtggagatgactacacgttcaaaacttagttgcttgagttggaacaaatatgctaagaaccaaatagctagtagtgattatgaaggaattgtaactgtttggacgatgaccactcgaaagagtttaatggaatatgaagagcatgaaaagcgtgcatggagtgttgatttttcaagaacggacccctctatgcttgtatctggtagtgatgattgtaaggtcaaagtttggtgcacaaatcaggaggccagtgttctaaatatagacatgaaagcaaacatatgctgcgtgaagtataatcctggatctgggaattacatcgcagttgggtctgcagaccatcacatccattattatgatttgagaaatattagccggccagtccatgttttcactgggcacaagaaggctgtttcatacgtgaaatttttgtccaacgatgaacttgcatcggcatcaacagatagtacactgcggttatgggatgtaaagcaaaacttaccagttcgtaccttcagaggccacgcaaatgagaaaaactttgttggccttacagttcgcagtgagtacattgcatgtggcagtgaaacaaatgaagtatttgtctaccacaaggaaatttctaagcctctgacatggcatagatttggtaccttagacatggaagacgcggaggatgaggctggatcttacttcatcagtgctgtatgctggaagagtgatcgccccaccatactaactgcaaatagtcaaggcaccatcaaagtgctggtgcttgctgcttaaatacaagaaaaaatgaacagaatgctgaatcgggattggttgttcctatgctacaaattggtgtaccattaaaattgtacagagtatcgaagtgtatatgataggttttagggatctcattgaggtattagctgaggatactatatgatccaatcaattaagaaactgaacttttgccaattaaggatctcaagtttaataaaataaattagttttaggattaaaaaaaaaaaaaaaaaa

SEQ ID NO: 2464 - protein, 672 aa, Pisum sativum
  G4629,RING/C3HC4 domain coordinates 46-88,121-204,371-667
MEEHSVGPLVPAVVKPEPSKNFSTDTTAAGTFLLVPTMSDLDKDFLCPICMQIIKDAFLTACGHSFCYMCIITHLRNKSDCPCCGHYLTNSNLFPNFLLDKLLKKTSDRQISKTASPVEHFRQAVQKGCEVTMKELDTLLLLLTEKKRKMEQEEAERNMQILLDFLHCLRKQKVDELKEVQTDLQFIKEDIGAVEKHRMDLYRARDRYSVKLRMLDDSGGRKSRHSSMDLNSSGLASSPLNLRGGLSSGSHTKKNDGKSQISSHGHGIQRRDPITGSDSQYINQSGLALVRKKRVHTQFNDLQECYLQKRRQAADKPHGQQERDTNFISREGYSCGLDDFQSVLTTFTRYSRLRVIAEIRHGDIFHSANIVSSIEFDRDDDLFATAGVSRRIKVFDFSAVVNEPTDAHCPVVEMTTRSKLSCLSWNKYAKNQIASSDYEGIVTVWTMTTRKSLMEYEEHEKRAWSVDFSRTDPSMLVSGSDDCKVKVWCTNQEASVLNIDMKANICCVKYNPGSGNYIAVGSADHHIHYYDLRNISRPVHVFTGHKKAVSYVKFLSNDELASASTDSTLRLWDVKQNLPVRTFRGHANEKNFVGLTVRSEYIACGSETNEVFVYHKEISKPLTWHRFGTLDMEDAEDEAGSYFISAVCWKSDRPTILTANSQGTIKVLVLAA

SEQ ID NO: 2465 - DNA, 1083 bp, Oryza sativa (japonica cultivar-group)
  G4630,family:bZIP
atggcgacaacacgcgcatctctcaccgatcccctccttccctctcccgcggcacgcgcgccagttaaagccaaaaagctctcatggtccatgcttcacgcaagcagcaaggacgagaggagaggacagagtggggaagctgaagctgaagcaagcggaggagtgcacgcgaatccctcctcgccggcgagaatgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacagatactgaagaatacaactgtgagcagaagagggccagttcttctgaaaatccccaaatcgggtctgcgggaggcggcaccagcgggctgcggaggtttgcgggaggcggagggcgacgagaagtttgtcctcaacgggttcaccgccgcgaatctcagcttcgatggcatggcgacggtgaccccgaacgggctgctcatgttgaccaacggcacgaaccagctcaagggccacgccttcttcccggcgctgctccagttccacaggacgcccaacagcatggcgatgcagtccttctccacggccttcgtcatcggcatcatcagcgcgttcgaggaccagggcagcggcagcccggcggcggcaggtggcagcggcagggcggcataa

SEQ ID NO: 2466 - protein, 360 aa, Oryza sativa (japonica cultivar-group)
  G4630,bZIP domain coordinates 118-130,163-242
MATTRASLTDPLLPSPAARAPVKAKKLSWSMLHASSKDERRGQSGEAEAEASGGVHANPSSPARMQEQATSSRPSSSERSSSSGGHHMEIKEGKEAPLRSLLLPFLDFHFTVPLSGMESDEEIGRVPELGLEPGGASTSGRAAGGGGGGAERAQSSTAQASARRRGRSPADKEHKRLKRLLRNRVSAQQARERKKAYLNDLEVKVKDLEKKNSELEERFSTLQNENQMLRQILKNTTVSRRGPVLLKIPKSGLREAAPAGCGGLREAEGDEKFVLNGFTAANLSFDGMATVTPNGLLMLTNGTNQLKGHAFFPALLQFHRTPNSMAMQSFSTAFVIGIISAFEDQGSGSPAAAGGSGRAA

SEQ ID NO: 2467 - DNA, 1262 bp, Glycine max
  G4631,family:bZIP
ggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggaggagattgatatgatgaccgatgcttatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgattactt

SEQ ID NO: 2468 - protein, 322 aa, Glycine max
  G4631,bZIP domain coordinates 192-204,234-313
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEEIDMMTDAYLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQILKNTTASRRGSNNGTNNAE

SEQ ID NO: 2469 - DNA, 780 bp, Zea mays
  G4632,family:bZIP
atcgcaggcagatagggaaggagaagcggagtgcgcgcggtccaaatctgcggaggcggaggcggaggcggagggcgagcaagaatgcaggagcagccggcgagctcgcggccttccagcagcgagaggtcgtctagctccgcgcaccacatggacatggaggtcaaggaagggatggagagcgacgaggagataaggagagtgccggagctgggcctggagctgccgggagcttccacgtcgggcagggaggttggcccgggcgccgccggcgcagaccgcgccctggcccagtcgtccacggcgcaggccagcgcgcgccgccgcgtccgcagccccgccgacaaggagcacaagcgcctcaaaagattactgaggaaccgggtgtcagctcaacaggcaagagagaggaagaaggcttatttgactgatctggaggtgaaggtgaaggacctggagaagaagaactcggagatggaagagaggctctccaccctccagaacgagaaccagatgctccgacagatactgaagaacaccactgtaagcagaagaggttcaggaagcactgctagtggagagggccaatagttcagaatgacaggaaaatagtaatgcattatatgctaaacatatgtttatgctcagtggatttggtcagtttgctttgtggccaaaggagggaaccccaaaaactgggggtgaaggatttgtgcagacagtcatatatatcactgtattaatacgaatggttcagaaaaagaagaacttatggagtgc

SEQ ID NO: 2470 - protein, 168 aa, Zea mays
  G4632,bZIP domain coordinates 32-44,79-158
MQEQPASSRPSSSERSSSSAHHMDMEVKEGMESDEEIRRVPELGLELPGASTSGREVGPGAAGADRALAQSSTAQASARRRVRSPADKEHKRLKRLLRNRVSAQQARERKKAYLTDLEVKVKDLEKKNSEMEERLSTLQNENQMLRQILKNTTVSRRGSGSTASGEGQ

SEQ ID NO: 2471 - DNA, 2046 bp, Glycine max
  G4633,family:RING/C3HC4
atggaagagctctcagcggggcctctcgtccccgccgtcgtcaaacctgaaccgtccaaaggcgcctccgccgctgcctccggcggcacgttcccggcctccacgtcggagccggacaaggacttcctctgtccgatttgcatgcagatcatcaaggacccgttcctcaccgcgtgcggccacagcttctgctacatgtgcatcatcacgcacctccgcaacaagagcgattgcccttgctgcggcgactacctcaccaacaccaacctcttccctaacttgttgctcgacaagcttattgttatacggtttctgtaccacatttgtagctactggaagaagacttctgcgcgtcaaatatcaaaaaccgcttcacctgtcgaacattttcggcaggtattgcaaaagggttctgatgtgtcaattaaggagctagacacccttttgtcacttcttgccgagaagaaaagaaaaatggaacaagaagaagctgagagaaatatgcaaatattgttagacttcttgcattgcttacgcaagcaaaaagttgatgagttgaaggaggtacaaactgatctccactttataaaagaggacataaatgctgtggagaaacatagaatggaattgtatcgtgcacgggacaggtactctgtaaaattgcagatgcttgacggttctgggggaagaaaatcatggcattcatcaatggacaagaacagcagtggctacggctgcgagaagacgacagaagggggagggttgtcatcagggagccatactaagaaaaatgatggaaagtctcatattagctctcatgggcatggaattcagagaaggaatgtcatcactggatccgattcacaatatataaatcaatcgggtcttgctctagttagaaagaagagggtgcatacacagttcaatgatctacaagaatgttacctacaaaagcgacggcatgcagctgataggtcccatagccaacaagaaagagatataagtctcataagtcgagaaggttatactgctggtcttgaagattttcagtcagtcttgacaactttcacacgctatagccgattgagagtcattgcagaactaagacatggggatatatttcattcagcaaatatagtgtcaagcatagagtttgactgcgatgatgatttgtttgctactgctggagtttcccggcgcatcaaagtttttgacttttctgctgttgtgaatgaacctacagatgctcactgtcctgttgtggagatgtctacacgttcaaaacttagttgcttgagttggaataaatatgctaagaatcaaatagctagtagtgattatgaaggaattgtgactgtttgggatgtaaccactcgaaagagtttaatggaatatgaagagcatgaaaagcgtgcatggagtgttgatttttcaagaacagatccctctatgcttgtatctggtagcgatgactgtaaggtcaaaatttggtgtacaaatcaggaagctagtgttctaaatatagacatgaaagcaaacatatgctgtgtcaaatataatcctggatctggcaattatattgcagttggatcagcagaccatcacatccattattatgatttgagaaatattagccgtccagtccatgttttcagtgggcacaggaaggctgtttcatacgtgaaatttctgtctaatgatgaacttgcttctgcatcaacagatagtacactgcgattatgggatgtgaaggaaaacttaccagttcgtactttcaaaggccatgcaaatgagaaaaactttgttggtcttacagtaagcagtgaatacattgcgtgtggcagtgaaacaaatgaagtctttgtgtaccacaaggaaatctcgagacctttgacttgccacagatttgggtcccctgatatggatgacgctgaagatgaggctggatcgtacttcattagtgctgtatgctggaagagtgatcgccccactattctaactgcaaatagtcaaggcaccatcaaagtgctggtgcttgcagcttga

SEQ ID NO: 2472 - protein, 681 aa, Glycine max
  G4633,RING/C3HC4 domain coordinates 43-85,118-201,368-664
MEELSAGPLVPAVVKPEPSKGASAAASGGTFPASTSEPDKDFLCPICMQIIKDPFLTACGHSFCYMCIITHLRNKSDCPCCGDYLTNTNLFPNLLLDKLIVIRFLYHICSYWKKTSARQISKTASPVEHFRQVLQKGSDVSIKELDTLLSLLAEKKRKMEQEEAERNMQILLDFLHCLRKQKVDELKEVQTDLHFIKEDINAVEKHRMELYRARDRYSVKLQMLDGSGGRKSWHSSMDKNSSGYGCEKTTEGGGLSSGSHTKKNDGKSHISSHGHGIQRRNVITGSDSQYINQSGLALVRKKRVHTQFNDLQECYLQKRRHAADRSHSQQERDISLISREGYTAGLEDFQSVLTTFTRYSRLRVIAELRHGDIFHSANIVSSIEFDCDDDLFATAGVSRRIKVFDFSAVVNEPTDAHCPVVEMSTRSKLSCLSWNKYAKNQIASSDYEGIVTVWDVTTRKSLMEYEEHEKRAWSVDFSRTDPSMLVSGSDDCKVKIWCTNQEASVLNIDMKANICCVKYNPGSGNYIAVGSADHHIHYYDLRNISRPVHVFSGHRKAVSYVKFLSNDELASASTDSTLRLWDVKENLPVRTFKGHANEKNFVGLTVSSEYIACGSETNEVFVYHKEISRPLTCHRFGSPDMDDAEDEAGSYFISAVCWKSDRPTILTANSQGTIKVLVLAA

SEQ ID NO: 2473 - DNA, 2373 bp, Solanum lycopersicum
  G4635,family:RING/C3HC4
atacccaatttgcatttgggggtatagagggagatggtggaaagttcagttggaggggtggtgccagcagtgaagggggaggtgatgaggaggatgggggacaaagaggaggggggtagtgtaactctaagggatgaagaagttgggacagtgacagaatgggaattggacagggaattgttgtgtcctatatgtatgcagatcataaaggatgcatttttaacagcttgtgggcacagtttttgctatatgtgcatagttactcatcttcacaacaagagtgattgcccctgttgttctcattatctcactaccagtcaactctatcccaatttcctacttgacaagctattgaagaagacatctgcccgtcagatttcaaaaactgcatcccctgttgaacagtttcgtcattcattggaacagggttctgaagtgtcaattaaggagctggacgctctattgttgatgttgtcagagaaaaagaggaaattggaacaggaggaagcagagcgaaatatgcaaattctgctagacttcttacagatgttaaggaagcaaaaagttgatgaactcaatgaggtgcaacatgatctgcaatacatcaaagaggacttaaattcagtagagagacatagaatagacctataccgggctagggaccggtattcaatgaagctccgaatgttagcagatgatcctattgggaaaaaaccttggtcttcatcaactgataggaactttggtggtcttttctccacttcacaaaatgcacctggaggattaccgactggaaacttgacattcaaaaaggtggacagcaaagctcaaataagctctcctggaccacagagaaaagatacttcaatcagtgaactgaactcacaacatatgagtcaatcaggtctggctgtggttaggaagaagcgtgtcaatgcacagttcaatgatctccaagaatgttacttgcaaaagagacgtcaattggcaaacaaatcgcgagttaaggaagaaaaggatgcagatgtcgtacaaagagaaggttacagtgaaggactagcagattttcagtctgtacttagcactttcactcgttatagtcggttaagagtcattgctgaacttcggcatggggatctgtttcactcggccaatattgtttcaagcattgaatttgatcgggatgatgagttgtttgctactgctggagtttcacggcgtataaaagtttttgacttctcttcagttgtaaatgaacctgcagatgcacactgccctgttgttgaaatgtctacccgatctaagctgagctgcttgagttggaataagtataccaagaaccacatagctagtagtgattatgatggaatagtaactgtatgggatgtgacgactagacagagtgtgatggaatatgaagagcatgagaaacgggcttggagtgttgatttttcacgcacagaaccctcgatgcttgtatctggcagtgatgattgtaaggtcaaagtttggtgcacgaagcaggaagcaagtgttcttaatattgacatgaaggcaaatatatgctgtgtaaaatataatcctggatctagtgttcatatagcggttggctctgcggatcatcatattcattattatgacttgaggaacaccagccagccggttcacatttttagtggccatagaaaagctgtttcatatgtaaaatttttgtccaacaatgaacttgcttcagcatcaacagacagtactctacgattgtgggatgtaaaagataatttgccggttcgcacgcttagaggacatacgaatgagaagaactttgttggtctctcagtgaacaatgaattcctgtcatgtggcagtgaaacaaatgaagtattcgtgtaccataaggcgatatccaaacccgtgacttggcatagatttggttccccagacatagacgaagcggatgaagatgcaggatcttatttcatcagcgcagtgtgctggaagagcgatagccctacgatgctagctgctaatagccagggaactataaaagtgttagtccttgcagcttgatgaagttaataaagctactagttaagaatgttcaaatctttttagtggaaaaacagtgaaatggaatttcacattcaatttttcctgtagatatctattcaaccatcaagatggcatggttccccccatatttgtcaatgtattcatcattaaaacatgtaacacaagttgtagggcttggtaaatttagaagaattttacaagtttgtgttttttttttcattgtgctgaaggacatcggatttacacaccatttcatggaataaactttactcgtattcagtgtttaaaaaaaaaaaaaaaaaa

SEQ ID NO: 2474 - protein, 677 aa, Solanum lycopersicum
  G4635,RING/C3HC4 domain coordinates 50-92,125-208,376-672
MVESSVGGVVPAVKGEVMRRMGDKEEGGSVTLRDEEVGTVTEWELDRELLCPICMQIIKDAFLTACGHSFCYMCIVTHLHNKSDCPCCSHYLTTSQLYPNFLLDKLLKKTSARQISKTASPVEQFRHSLEQGSEVSIKELDALLLMLSEKKRKLEQEEAERNMQILLDFLQMLRKQKVDELNEVQHDLQYIKEDLNSVERHRIDLYRARDRYSMKLRMLADDPIGKKPWSSSTDRNFGGLFSTSQNAPGGLPTGNLTFKKVDSKAQISSPGPQRKDTSISELNSQHMSQSGLAVVRKKRVNAQFNDLQECYLQKRRQLANKSRVKEEKDADVVQREGYSEGLADFQSVLSTFTRYSRLRVIAELRHGDLFHSANIVSSIEFDRDDELFATAGVSRRIKVFDFSSVVNEPADAHCPVVEMSTRSKLSCLSWNKYTKNHIASSDYDGIVTVWDVTTRQSVMEYEEHEKRAWSVDFSRTEPSMLVSGSDDCKVKVWCTKQEASVLNIDMKANICCVKYNPGSSVHIAVGSADHHIHYYDLRNTSQPVHIFSGHRKAVSYVKFLSNNELASASTDSTLRLWDVKDNLPVRTLRGHTNEKNFVGLSVNNEFLSCGSETNEVFVYHKAISKPVTWHRFGSPDIDEADEDAGSYFISAVCWKSDSPTMLAANSQGTIKVLVLAA

SEQ ID NO: 2475 - DNA, 867 bp, Zea mays
  G4637,family:MYB-(R1)R2R3
atggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctccaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtttgcggcgacggcagctcctcctcctcctcctggcactcccactcccactcccaccaatgggctctgaattttttacaggcggcggcgccctgctacagaggccaatag

SEQ ID NO: 2476 - protein, 288 aa, Zea mays
  G4637,MYB-(R1)R2R3 domain coordinates 14-116
MGRSPCCEQAHTNKGAWTKEEDQRLVAYIKAHGEGCWRSLPKAAGLLRCGKSCRLRWINYLRPDLKRGNFTEEEDDLIIKFHELFGNKWSLIAGRLPGRTDNEIKNYWNTHIKRKLLARGMDPQTHRPLASATAGQQHYQLQEPQKRAAGGGPAGHPHQDHLEVVVISNSPDEAYSRSSDDEPRSATPPRRHLDIDLNLSISLAAYQPPEETGIIKQPLVMKQEQETAAGGTNAAAVCLCLNSLGYRPGVECVCGDGSSSSSSWHSHSHSHQWALNFLQAAAPCYRGQ

SEQ ID NO: 2477 - DNA, 678 bp, Zea mays
  G4638,family:MYB-(R1)R2R3
atggggaggtcgccgtgctgcgagaaggcgcacacgaacaagggcgcctggaccaaggaggaggaccagcggctcgtcgcctacatcaaggcccacggcgaaggctgctggaggtcgctccccaaggccgcgggcctgctgcgctgcggcaagagctgccgcctccggtggatcaactacctgcgccccgacctcaagcgcggcaacttcacccaggaggaggacgacgtcatcatcaagctccaccaggtcctcggaaacaagtggtcgctgatcgccgcccagctgccggggcggacggacaacgagatcaagaactactggaacacgcacatcaagcgcaagctcatcgcccggggcatcgacccacggacgcaccagtcggcgagtgccgccgcagttgcccccgccgccgccgccgccgcgcaaagcagctatcgccaccatggcgacgacgaggcggtggcgcggcgcagctgctcgcgagacagcggctgcatcgcggcgcacagcagcgacgacgacgacagcacgtccgggtccgtgccacaccaacatgctgtcggcggcatcgacctcaacctgtcgctaagcccaccgacgacgagccaaccgtcatcgccggccgccgccaagggagtcgtagctagcggatatggccaagggagtgagagctag

SEQ ID NO: 2478 - protein, 225 aa, Zea mays
  G4638,MYB-(R1)R2R3 domain coordinates 14-116
MGRSPCCEKAHTNKGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKLIARGIDPRTHQSASAAAVAPAAAAAAQSSYRHHGDDEAVARRSCSRDSGCIAAHSSDDDDSTSGSVPHQHAVGGIDLNLSLSPPTTSQPSSPAAAKGVVASGYGQGSES

SEQ ID NO: 2479 - DNA, 633 bp, Glycine max
  G4639,family:MYB-(R1)R2R3
atgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttcaccctcgaagaagaccaactcatcatcaaactccacagcctccttggcaacaagtggtctctaattgctagaagattgccgggtagaacggacaatgagataaagaattactggaatactcacataagaaggaagcttctgagcagaggaattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatga

SEQ ID NO: 2480 - protein, 210 aa, Glycine max
  G4639,MYB-(R1)R2R3 domain coordinates 14-116
MGRSPCCEKAHTNKGAWTKEEDHRLISYIRAHGEGCWRSLPKAAGLLRCGKSCRLRWINYLRPDLKRGNFTLEEDQLIIKLHSLLGNKWSLIARRLPGRTDNEIKNYWNTHIRRKLLSRGIDPATHRPLNDDKVLERCPDLNLELTISPPRQPQSDQHHLKPVGRNSNLCFACSLGLQNSKDHCSCALNTANAASGHDFLALKTSVLEMK

SEQ ID NO: 2481 - DNA, 992 bp, Arabidopsis thaliana
  G464,family:IAA
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 2482 - protein, 239 aa, Arabidopsis thaliana
  G464,IAA domain coordinates 20-28,71-82,126-142,187-224
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 2483 - DNA, 975 bp, Zea mays
  G4640,family:MYB-(R1)R2R3
atgtatgccctccgttgcacttgcactgcaccccctgtctgtccccacccttctgccctggcttatctctttccgcttccccctgttataatagcaaccaaaccaaaccaaaccagagctcaggaggagcttccacgcaaactcaggggaggcgcgcgcaagcaagcacacgagggagaaccaggcatggggaggtctccgtgctgcgagaaggcgcacacgaacaagggcgcctggaccaaggaggaggaccagcgcctgatcgcctacatcagggcgcacggcgaagggagctggcgctcgctgcccaaggccgcgggactcctccgctgcggcaagagctgcaggctccgctggatgaactacctccgcccggacctcaagcgcggcaacttcaccggcgacgacgacgagctcatcatcaagctccacgccctgctcggcaacaagtggtcgctcatcgcggggcagctgcccggccggacggacaacgagatcaagaactactggaacacgcacatcaagcgcaagctgctcagccgcggcatcgacccgcagacgcaccgcccgctcagcggcggcgcgggcagcgcgctcaccaccacgtccagcaccgccggcttcccgtcccccgcgccggcgtccaggtccaggcccacgcccacgcccccgcccaccgtcgtcgtcccgcccaatgcgatcttcgtgcgcccggcgccgtcggaggacggccacagcagcagcggcgcgagcacggacgcgccgcgctgccccgacctcaacctggacctggacctgtccgtgggcccgccgcccaagacgccggcggccacgcagcagcagcggcggcggacgaccatctgcctgtgctaccacctcggtgtccgcggcggcgaggcctgcagctgcgagaccgcgtcgtcgctggcgggcttccggtttctccagccgctggaggagggccagtacatatag

SEQ ID NO: 2484 - protein, 324 aa, Zea mays
  G4640,MYB-(R1)R2R3 domain coordinates 76-178
MYALRCTCTAPPVCPHPSALAYLFPLPPVIIATKPNQTRAQEELPRKLRGGARKQAHEGEPGMGRSPCCEKAHTNKGAWTKEEDQRLIAYIRAHGEGSWRSLPKAAGLLRCGKSCRLRWMNYLRPDLKRGNFTGDDDELIIKLHALLGNKWSLIAGQLPGRTDNEIKNYWNTHIKRKLLSRGIDPQTHRPLSGGAGSALTTTSSTAGFPSPAPASRSRPTPTPPPTVVVPPNAIFVRPAPSEDGHSSSGASTDAPRCPDLNLDLDLSVGPPPKTPAATQQQRRRTTICLCYHLGVRGGEACSCETASSLAGFRFLQPLEEGQYI

SEQ ID NO: 2485 - DNA, 2292 bp, Arabidopsis thaliana
  G472,family:ARF
gacgatagaagctggttttacgggagagaaattagagaggttacagttacagagcaggaaggattgcgttgcgttacgattcagatctctctcgatcgttacttacatgcattagagaacaagaaaacgtggagacggaatccaagggaccttcttcttcaatttaattcctcactttattacgcacccttcttttattttcgactgtttcagcttccggttcttcatcggagagagatagagagactgtgtgttttggtgtgactgatagaagatttaatcagctgatggcaaatcgcggaggtgaatatctgtacgatgagttatggaaattatgcgcgggacctcttgttgatgttcctcaagctcaagaaagagtttattattttcctcaaggtcacatggaacaactcgaagcgtcaacgcaacaagtcgacttaaatacgatgaagcctctttttgttcttcctcctaagattctctgcaatgttatgaacgttagtcttcaggcggagaaagatacggatgaggtctatgctcagattactttgatccctgttggaactgaagttgatgaacctatgagtcctgatccctctcctcctgagttgcaaaggccgaaagttcactctttcagcaaggttttgacagcgtctgatacaagcacccatggtggcttttctgttctaaggaaacatgccacggaatgtcttcctccgctggatatgactcagcaaaccccgacccaggagttagtagccgaagatgtgcacggttatcagtggaaattcaagcatatttttagaggccaaccacggaggcatctattgacgacagggtggagcacctttgttacatcaaagagattggttgctggggacacctttgtattcctgagaggggagaacggagagttgcgagttggagtcagacgtgctaatcttcaacagagcagtatgccttcatccgttatatcaagtcatagtatgcatctgggagtgcttgctactgcacgccatgctactcaaacgaaaactatgttcattgtatactataaaccaaggacaagccaattcatcattagcttgaacaaatatctagaagccatgagcaataagttctctgtagggatgagatttaagatgcgttttgagggagaggattcccctgaaagaagatattctggcacggttattggtgtgaaagactgctcccctcactggaaagactcaaaatggcgatgcttagaagttcattgggatgagcctgcatcgatttcaagacccaataaggtttcaccatgggaaattgaaccgtttgtaaattcagaaaacgttcccaaatcagttatgctgaagaacaaaaggccccgtcaagttagtgaagtatctgcacttgatgtaggcataacagcttcaaacctttggagctctgttttgacgcaaccccatgagtttgcacaatcgtgcatcacctcacagtggagttctcctcagcaatgtcatcgtgatgcaaatgaggatgctaagaaatctgactggctaaataactcttactctgtgtcaaatgtagcaaaagactcaacactgaacgaccaaatggtttccccagtcgagcagaagaagcctgagacaaccgctaattatagattatttggaattgatctgatgagttcctccctagcggttcctgaggagaaaactgcacccatgcgaccaatcaacatatccaaaccgactatggacagccactcagacccaaaatcagagatttcaaaagtatcagaagagaaaaagcaggaacctgcggagggatcaccaaaagaggtccaaagcaagcaaagcagttctacaagaagccgtaccaaggtgcagatgcaaggcgtacctgtgggcagggctgtggatttaaatgcgctaaaggggtacaacgagctcatagatgacattgagaagctgtttgacataaaaggggaactgcggagtcgcaatcaatgggaaatagtgttcacagacgatgagggagatatgatgcttgtcggtgatgacccatggcctgagttctgcaacatggtgaagagaatattcatatggtcgaaagaggaagtgaagaaaatgacgcctgggaaccaactccggatgctgttaagggaagttgaaacaacactaacaacaacttccaaaacagataatcattccaactaatttttattctattctctatcagtcttcgtctccttcttatttgctttgtctttcggaattatcttgtttgtgtctgtgttttgttgcg

SEQ ID NO: 2486 - protein, 638 aa, Arabidopsis thaliana
  G472,ARF domain coordinates 12-343
MANRGGEYLYDELWKLCAGPLVDVPQAQERVYYFPQGHMEQLEASTQQVDLNTMKPLFVLPPKILCNVMNVSLQAEKDTDEVYAQITLIPVGTEVDEPMSPDPSPPELQRPKVHSFSKVLTASDTSTHGGFSVLRKHATECLPPLDMTQQTPTQELVAEDVHGYQWKFKHIFRGQPRRHLLTTGWSTFVTSKRLVAGDTFVFLRGENGELRVGVRRANLQQSSMPSSVISSHSMHLGVLATARHATQTKTMFIVYYKPRTSQFIISLNKYLEAMSNKFSVGMRFKMRFEGEDSPERRYSGTVIGVKDCSPHWKDSKWRCLEVHWDEPASISRPNKVSPWEIEPFVNSENVPKSVMLKNKRPRQVSEVSALDVGITASNLWSSVLTQPHEFAQSCITSQWSSPQQCHRDANEDAKKSDWLNNSYSVSNVAKDSTLNDQMVSPVEQKKPETTANYRLFGIDLMSSSLAVPEEKTAPMRPINISKPTMDSHSDPKSEISKVSEEKKQEPAEGSPKEVQSKQSSSTRSRTKVQMQGVPVGRAVDLNALKGYNELIDDIEKLFDIKGELRSRNQWEIVFTDDEGDMMLVGDDPWPEFCNMVKRIFIWSKEEVKKMTPGNQLRMLLREVETTLTTTSKTDNHSN

SEQ ID NO: 2487 - DNA, 1281 bp, Arabidopsis thaliana
  G502,family:NAC
aattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 2488 - protein, 289 aa, Arabidopsis thaliana
  G502,NAC domain coordinates 10-155
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 2489 - DNA, 1217 bp, Arabidopsis thaliana
  G514,family:NAC
tccaagatcaaatcaagaaacccattaaaaaaaaaaatcaggttttggtttcagttttaagggtttaaggtttcttggggaagaaacgatggagactttttgtgggtttcaaaaggaggaagagcagatggatttacctcctgggttcaggtttcatccaacagatgaagaactcataactcactatctccataataaggttcttgacaccagcttctcagctaaagctatcggtgaagttgatttaaacaaatcagagccatgggagttaccatggatggcaaaaatgggtgagaaagaatggtattttttctgtgtgagagacagaaagtatcccaccggtttaagaactaaccgagcaactgaagccggttattggaaggcgaccgggaaggataaagagatataccgaggcaaatcacttgttgggatgaagaagacacttgttttctatagaggaagagctcctaaaggtcagaaaaccaactgggtgatgcatgagtacaggcttgaaggaaaattctctgcccataacttgccgaaaaccgcaaagaagtgggtatgcagggtgttccaaaagagtgctggagggaagaagatcccgatttcgagtctaatccgaatcggttcactcggaaccgactttaacccttcgcttttgccctctttaaccgattcttcgccttacaacgataaaaccaaaacagaaccggtctacgtgccctgcttctccaaccaaacggatcaaaaccaaggaaccacactcaattgcttcagcagccctgttcttaactcgatccaagccgacatttttcacaggattccactctatcaaactcagtccctccaggtttctatgaatctacagagcccggttctcacgcaagaacactcagttctacatgctatgatcgagaacaacagaagacaaagtctcaaaacgatgagtgtctcacaagaaaccggagtttcaactgacatgaacactgatatctcatcggattttgaatttggtaagagacggtttgattctcaagaagatccgtcttcctctactggaccggttgatcttgaacctttctggaattactgaagatgattcaagattctcatgtccattaatttactgtggtgtgttaaagtttgtataggctattgtcatatactctcatatcaacttccactatatattataacaaattaaagaaacttaaaaa

SEQ ID NO: 2490 - protein, 334 aa, Arabidopsis thaliana
  G514,NAC domain coordinates 19-161
METFCGFQKEEEQMDLPPGFRFHPTDEELITHYLHNKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKKWVCRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 2491 - DNA, 1462 bp, Arabidopsis thaliana
  G515,family:NAC
caaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgataacaataaaagtgatcaataacaccttttctactttccaaattatttacaacagtacaagtgtatgctatgatgtctatcttggtttgtaactttaccatactgtatgtgtgatatgtataaaactggtaaatttgtgaagacaaatttgtatccattgacataataatgtctatcttgttttgttaaaaaaaaaaaaa

SEQ ID NO: 2492 - protein, 394 aa, Arabidopsis thaliana
  G515,NAC domain coordinates 6-149
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 2493 - DNA, 531 bp, Oryza sativa (japonica cultivar-group)
  G5158,family:bZIP
atgacgattaaaaggaaggacgacgggcaggtcgtgaagcaatcagtcaaagcggttggcgggggacttctagaaagggtggatagcgacgacgaggagatagtagggagggtgccggagttcgggctggcgctgccggggacgtcgacgtcgggcagaggtagtgttcgggttgcaggtgacgcggcggcgacggcggccgggacgtcgtcgtcgtcgcccgcggcgcaggccggcgtcgccggcagcagcagcagcgggcgccgccgcggacgcagccccgccgacaaggagcaccggcgcctcaaaagattgctgaggaaccgggtgtcagcgcagcaggctcgggagaggaagaaggcgtacatgagtgagctggaggcgagggtgaaggacctggagaggagcaactcagagctggaggagaggctctctaccctgcaaaacgagaaccagatgcttaggcaggtgctgaagaacacaacagcaaacagaagagggccagacagcagtgccggcggagacagctag

SEQ ID NO: 2494 - protein, 176 aa, Oryza sativa (japonica cultivar-group)
  G5158,bZIP domain coordinates 28-42,88-167
MTIKRKDDGQVVKQSVKAVGGGLLERVDSDDEEIVGRVPEFGLALPGTSTSGRGSVRVAGDAAATAAGTSSSSPAAQAGVAGSSSSGRRRGRSPADKEHRRLKRLLRNRVSAQQARERKKAYMSELEARVKDLERSNSELEERLSTLQNENQMLRQVLKNTTANRRGPDSSAGGDS

SEQ ID NO: 2495 - DNA, 753 bp, Oryza sativa (japonica cultivar-group)
  G5159,family:Z-CO-like
atgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccggcttctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtga

SEQ ID NO: 2496 - protein, 250 aa, Oryza sativa (japonica cultivar-group)
  G5159,Z-CO-like domain coordinates 2-33,63-105
MKVQCDVCAAEAASVFCCADEAALCDACDRRVHSANKLAGKHRRFSLLQPLASSSSAQKPPLCDICQEKRGFLFCKEDRAILCRECDVTVHTTSELTRRHGRFLLTGVRLSSAPMDSPAPSEEEEEEAGEDYSCSPSSVAGTAAGSASDGSSISEYLTKTLPGWHVEDFLVDEATAGFSSSDGLFQGGLLAQIGGVPDGYAAWAGREQLHSGVAVAADERASRERWVPQMNAEWGAGSKRPRASPPCLYW

SEQ ID NO: 2497 - DNA, 1053 bp, Arabidopsis thaliana
  G516,family:NAC
atggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactatttccattcaaactttaagcacttgtcctagttttggtagctcaaatcctctataccaaatcactgacttgcaggaatctcctaactcaatcaagttagtgtcattagctcaagaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatga

SEQ ID NO: 2498 - protein, 350 aa, Arabidopsis thaliana
  G516,NAC domain coordinates 6-141
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 2499 - DNA, 1080 bp, Arabidopsis thaliana
  G517,family:NAC
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 2500 - protein, 359 aa, Arabidopsis thaliana
  G517,NAC domain coordinates 6-153
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 2501 - DNA, 1022 bp, Solanum lycopersicum
  G5170,family:AP2
acaaaaatcaaaagatgtcaagcccactagagatagatacttcattttcacattccaatttgttgtttttggaagatgaatcatcatggagtaatactcatgatccatttgttgatattgatgaatatctaccaataattataccatgtaatgatgaagaaatagtagtagaatcctcaaacgctagtactacaacaacaacaacaacaacatcaaaagtagcaagtatccaaaatattcatcatgatcaagaagaggtaacatccatagagaaaaaacatgaagatgatcaagaaaaacattatattggagttagaaagaggccatggggtaaatatgcatcagaaattagggattcaacgcgtaatggaattagggtttggttaggaacatttgatactgctgaagaagctgctttagcttatgatcaagccgcattatcaatgaggggtccttggtctctactcaattttccaatggaacatgttaaaaaatctcttgaaaatattgagtattcttgtaaagatggattatctccagctgctgttttaaaagctactcataaaactagaagagtcaagcacaagagaagtagtagaaagaagaagaatgagaatttggaaaatgtttttgtttttcaagacttgggagttgaattattagaagagcttttaatgacttcatcataggaatgtttattatattcttcgtgtcgaaaatactaagttcagttttcgtgggagataataatcaagatcgcaatgtacgagtctcttttttttcttttttttttatttgttctggatttcttgaagaatttagagtttagtttcaagaagagcttttgatgagttgaaataatgtctcagacttgttttggtacatatagatttgtctttttttttttttaatttttattcactttctttgctattttgttataaataaataaataaataccaatgctcaccaaaaaaaaaaaaaaaaaaaaaaaaaaaaaaaaaaaaaaaaaaaaaaaaaaa

SEQ ID NO: 2502 - protein, 224 aa, Solanum lycopersicum
  G5170,AP2 domain coordinates 94-162
MSSPLEIDTSFSHSNLLFLEDESSWSNTHDPFVDIDEYLPIIIPCNDEEIVVESSNASTTTTTTTTSKVASIQNIHHDQEEVTSIEKKHEDDQEKHYIGVRKRPWGKYASEIRDSTRNGIRVWLGTFDTAEEAALAYDQAALSMRGPWSLLNFPMEHVKKSLENIEYSCKDGLSPAAVLKATHKTRRVKHKRSSRKKKNENLENVFVFQDLGVELLEELLMTSS

SEQ ID NO: 2503 - DNA, 1079 bp, Oryza sativa (japonica cultivar-group)
  G5171,family:AP2
gcaggaattcggcacgaggcaaaatcaaattcaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcccgcgcgctcctcaacttcccgctccgcatcggctccgagatcgccgccgcggccgccgccgccgccgcggggagggagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgacaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaat

SEQ ID NO: 2504 - protein, 303 aa, Oryza sativa (japonica cultivar-group)
  G5171,AP2 domain coordinates 145-209
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGRERPYPDPASSGSSSPSSSSSSSSSSSSGSPKRRKRGEAAAASMAMALVPPPTPPAQAPVQLALPAQPWFAAGPIQQLVS

SEQ ID NO: 2505 - DNA, 989 bp, Glycine max
  G5184,family:AP2
ccagcgtccgcccccacccgtccgtaaaaaacagagcaactactcaattcttcactctgtttccccttaccttacacactctaacacatggattcaccttcctccttcttcaactcaccctcttccggtttctgctccgaatcttcctctccggaagccttctcgtgggaagggtacctacccttcaacgagaacgacccggaggagatgcttctatacggcatgatcgccggcgcgacaaccgaggagcactccggcgagagggcgagctcggaggagagtgctgcagcacggaaggagaagtcgtaccgcggcgtacggcggcggccgtgggggaagttcgcggcggagataagggactccacgcgccacgggatgagggtgtggctggggacattcgacagcgccgaagccgcggctctggcttacgaccaagccgcgttctccatgcgcggctcggcggcgattctcaacttccccgcggagatcgttagagagtcgcttaaagagatgaactacgctcatgatgattccaacaacgaagaagggtgctcccctgttgtcgctctcaagaggaaacactctttgagaaggaaaattaacgtcaggaagaagaagaacaacaataacaatagcaaactacaaagtagtaccgtagacaatgctgtcgtgtttgaagaccttggtcctgattacttggaacagctgttgatgtcctctgatcatcatattcccaccaccttctgattcatttattcctcaattgcaattcagatctcaaaaaccttataaatatccattgcatagtttctacctagggtttttgtgttagtagtgttaattccttcttcttctttgttcttttgtttttgtaaggctaaaatgcttaggtcatgtttggatgacagatttgaacttcttttcagttcttatctttttttctttgtttttgtttttgttttcctactctgggagaattttcttcttta

SEQ ID NO: 2506 - protein, 219 aa, Glycine max
  G5184,AP2 domain coordinates 71-139
MDSPSSFFNSPSSGFCSESSSPEAFSWEGYLPFNENDPEEMLLYGMIAGATTEEHSGERASSEESAAARKEKSYRGVRRRPWGKFAAEIRDSTRHGMRVWLGTFDSAEAAALAYDQAAFSMRGSAAILNFPAEIVRESLKEMNYAHDDSNNEEGCSPVVALKRKHSLRRKINVRKKKNNNNNSKLQSSTVDNAVVFEDLGPDYLEQLLMSSDHHIPTTF

SEQ ID NO: 2507 - DNA, 1069 bp, Zea mays
  G5185,family:AP2
aattcccatccatcagtcacttggggggcctgcgggacatcgacgcatcccatatctataggcataatggagcactacgactcctatctatgcagcggcagcatgcatagctacggcggcgttggcggagccacggacgcggcgttggacgccggcggtgacgacatgcagcgcctgctcaacgcgctcatggacgacatggctgccgagtccgactccttctccgacgacatggaggcagcctcctccgagtcctcgtcctccgcctgctcggccaacagccagcaggaggccacccggcggccacagcagcaaccggacggtggccacagcaacggtagcaacaagagctccaagaagcagcatcagcagcagccgccggctccctacatcggcgtgcgcaagcgtccctggggcaagttcgcggccgagatccgcgactccacgcgcaagggcgcccgcgtctggctgggcaccttcgacagcccggaggccgccgcgatggcctacgaccaggccgccttctccgtgcgcggcgccgccgccgtgctcaactttcccgtggagcgcgtgcaggagtcgctgcgcgcgctggcgctctcttccgcctcctctgccgcgggctcccctgtcctggcgctcaagtgccgccactccatacgcaagcgctccccgacaagaacaagaacaagaacaagaagcaggagcggcagcaacagggtggccgtggccgccgccgcaccacagcagccgccgtgccccaccagcgttgtggagctggaggacctgggcgccgattatctggacgagctcctccgggtgtcatccgagttccattggcaataacccatagcgaatggcggtcctgcgaggtgcaagcgatagcgaggttgatgggttggggatcgagttcagttgtcatcacaaatacagaatgcctgcagattgttgctctgctctgtccttgctcgccaattgcgaatcgacgacgagttgcaactcttctttaaaaaaaaaaaataaaaaaaaaaaaaaaaaaaaaaataaaaaaaaaaaaaaaaaataaaaa

SEQ ID NO: 2508 - protein, 259 aa, Zea mays
  G5185,AP2 domain coordinates 108-173
MEHYDSYLCSGSMHSYGGVGGATDAALDAGGDDMQRLLNALMDDMAAESDSFSDDMEAASSESSSSACSANSQQEATRRPQQQPDGGHSNGSNKSSKKQHQQQPPAPYIGVRKRPWGKFAAEIRDSTRKGARVWLGTFDSPEAAAMAYDQAAFSVRGAAAVLNFPVERVQESLRALALSSASSAAGSPVLALKCRHSIRKRSPTRTRTRTRSRSGSNRVAVAAAAPQQPPCPTSVVELEDLGADYLDELLRVSSEFHWQ

SEQ ID NO: 2509 - DNA, 871 bp, Glycine max
  G5186,family:AP2
tgaaagcataccacagagccacgcacataagaggagagggaaagaaaacaaaaacaaaacagctgaattttggtgtcagtctacattaagatttcaagagatggattttgattcatctttcttccaataccaaaactttaactcttcctttgtaaattcctctgtttgtgcagaaccattcccttgggaagactttcttttcttcaatgaagaaaacaccaccaccaccaccaccgcccttgattccttcaccatcactgaccactcctcacaatcacaaatcaaggaatcatcatcctcagattattccaactcttcaggctccttggtcagcagcactgagtcatcacaactagaagtgtcatccaatttaactcatgcaagccatcaactcaaagaaacacatgcatcaccacaaccacaaccaccaaaggaaactaacaaagacaagagaccctttagaggagtgaggagaaggccatgggggaaatttgctgcagaaataagagactcaacgagaaatggtgttagagtttggattggcacatttgacactgctgaagcagcagcactggcttatgatcaagctgctttgtccacaagagggtccatggcagtgctaaatttcccagaagaagtggtgagggaatcactcaaagacatgcagagcaataataagccaatatcattggaagatggttcctctccagtgttggcactcaagagaaaacacaccatgagaagaaaatccaacgctaccaacaaaaaaacaagagggaccatggaatggaatcacgcaatgtgaatagtattacacaaaacgcgctggtgttggaggattagggttctgagtacttggagcaacttctca

SEQ ID NO: 2510 - protein, 234 aa, Glycine max
  G5186,AP2 domain coordinates 117-185
MDFDSSFFQYQNFNSSFVNSSVCAEPFPWEDFLFFNEENTTTTTTALDSFTITDHSSQSQIKESSSSDYSNSSGSLVSSTESSQLEVSSNLTHASHQLKETHASPQPQPPKETNKDKRPFRGVRRRPWGKFAAEIRDSTRNGVRVWIGTFDTAEAAALAYDQAALSTRGSMAVLNFPEEVVRESLKDMQSNNKPISLEDGSSPVLALKRKHTMRRKSNATNKKTRGTMEWNHAM

SEQ ID NO: 2511 - DNA, 1071 bp, Arabidopsis thaliana
  G521,family:NAC
atggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccgacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaa

SEQ ID NO: 2512 - protein, 356 aa, Arabidopsis thaliana
  G521,NAC domain coordinates 7-156
MGKTNLAPGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKKNGLGPRHGSQYGAPFKEEDWSDKEEEYTQNHLVAGPSKETSLAAKASHSYAPKDGLTGVISESCVSDVPPLTATVLPPLTSDVIAYNPFSSSPLLEVPQVSLDGGELNSMLDLFSVDNDDCLLFDDFDYHNEVRHPDGFVNKEAPVFLGDGNFSGMFDLSNDQVVELQDLIQSPTPHPPSPPAQASIPDDSRSNGQTKDD

SEQ ID NO: 2513 - DNA, 1106 bp, Arabidopsis thaliana
  G523,family:NAC
cttgtaccggaatcaggtttttgcttttcttctagggtttaaggttatttaaaaacagatggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattactgaagattcagaacctggaaaggctattaatttaaggtcaccaagtaaagaaaatcttttg

SEQ ID NO: 2514 - protein, 329 aa, Arabidopsis thaliana
  G523,NAC domain coordinates 20-140
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 2515 - DNA, 1062 bp, Arabidopsis thaliana
  G524,family:NAC
ttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggttgatcaaatatctaatttgttaaaaaaaaaaaaaaaaaaaaaaaaaaaaaaaaaaaaaaaa

SEQ ID NO: 2516 - protein, 268 aa, Arabidopsis thaliana
  G524,NAC domain coordinates 18-157
MEKRSSIKNRGVLRLPPGFRFHPTDEELVVQYLRRKVTGLPLPASVIPETDVCKSDPWDLPGDCESEMYFFSTREAKYPNGNRSNRSTGSGYWKATGLDKQIGKKKLVVGMKKTLVFYKGKPPNGTRTNWVLHEYRLVDSQQDSLYGQNMNWVLCRVFLKKRSNSNSKRKEDEKEEVENEKETETEREREEENKKSTCPIFYDFMRKDTKKKRRRRRCCDLNLTPATCCCCSSSTSSSSVCSSALTHTSSNDNRQEISYRENKFCLFL

SEQ ID NO: 2517 - DNA, 1040 bp, Arabidopsis thaliana
  G528,family:GF14
ccacgcgtccgccattaaacaaaaaaaaatcaaatctctctctttctctctctaatggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggagcagatggacgaggcctgaggatctagatgaagggggggagggttgttacgcgatgtttctgccaccaaatcgatctcaaaatccccataacctttgctcaaaaactgtgaaaaaagattgaagtgtttatgatgattatgattgtgcacagcttgatgatttatctactctactaaacctctgtgctcttaatatttattgtctcgactctgctcaagccttaaaaacatctttctccttaaaaaaaaaaaaaaaaa

SEQ ID NO: 2518 - protein, 248 aa, Arabidopsis thaliana
  G528,GF14 domain coordinates 230-237
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 2519 - DNA, 1031 bp, Arabidopsis thaliana
  G533,family:GF14
ctcaatttctttttttcttccagaaatttcctccgatttcaaaattttccggtgaaatcgaaaaaaaaagcgagatcttcttctctaatggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatctcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcaggagcagatggatgaggcctgaaggtctaatggaagaaaagacggttatgtaatgtacctgcaaccgtaaccgaaaatctgagttcaacctcctttgctgtaaaacttgtcgaaaagaaaagtttgtttttttatgacagattatgtgcacagctttggtgttatctgctgctctgtatcaactctgtttttgtttggtaatttatcctcatctttgct

SEQ ID NO: 2520 - protein, 248 aa, Arabidopsis thaliana
  G533,GF14 domain coordinates 7-243
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 2521 - DNA, 804 bp, Arabidopsis thaliana
  G534,family:GF14
atggcgacaccaggagcttcctcagcaagagatgaattcgtatacatggcgaaactcgccgaacaagcagagcgttacgaagaaatggttgaattcatggagaaagtcgcgaaagctgttgacaaagacgaactcaccgtcgaagaacgtaatctcctctccgtcgcttacaaaaacgtcatcggagctcgtcgtgcttcgtggagaatcatttcatcgatcgaacaaaaggaggagtctcgcggtaacgatgaccacgtttcgttgatccgtgactacagaagcaaaatcgaaacggaactttctgatatctgtgacggaatccttaagcttctcgatacgattctcgttcccgctgctgcttctggagattcgaaggtgttttatctgaagatgaaaggtgattatcataggtacttggctgagttcaaatctggtcaagagaggaaagatgctgctgaacatactcttactgcttacaaagctgctcaggatattgctaattctgaattggctccaacgcatccgattcgtcttggtcttgcgttgaacttctctgtgttttactatgagattctcaattctccagatcgtgcttgtaatctcgctaagcaggcgtttgatgaagcaattgctgaattggatactcttggtgaagagtcatacaaggacagtactttgattatgcagcttcttcgtgataacctcactctctgggcttctgatatgcaggacgatgttgctgatgacatcaaagaagcagcaccagcagcagcaaaacccgctgacgagcaacaatcctaa

SEQ ID NO: 2522 - protein, 267 aa, Arabidopsis thaliana
  G534,GF14 domain coordinates 232-240
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWASDMQDDVADDIKEAAPAAAKPADEQQS

SEQ ID NO: 2523 - DNA, 1126 bp, Arabidopsis thaliana
  G535,family:GF14
aaatctctctcaatctctctcagatctgaatccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggacaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttgaaactcagttttctctcttattaatgatttgccattcaccaaaaaaaaa

SEQ ID NO: 2524 - protein, 267 aa, Arabidopsis thaliana
  G535,GF14 domain coordinates NA
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 2525 - DNA, 768 bp, Arabidopsis thaliana
  G536,family:GF14
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 2526 - protein, 255 aa, Arabidopsis thaliana
  G536,GF14 domain coordinates 226-233
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 2527 - DNA, 1325 bp, Arabidopsis thaliana
  G537,family:GF14
agattagatcttggttccaaatttcactcttttcctctaaaacgcatttatcactttccctcattaaacacaaaaactcattcatcgtcctctctcgcttgacctacaacacccgattctctaatcgaaaccgtttctctctttttgatcagatctcagatctttccctctttgattcttcttccttagatcgattctctctagaaacaacaatggcgtctgggcgtgaagagttcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggatattgctaatgcagagcttgctccaacacacccaattcgtcttggtcttgcattgaacttctctgtgttctattacgagatcctcaattctcctgatcgtgcctgtaacctcgccaaacaggcctttgatgaggcgattgcagagttggacactcttggtgaagagtcatacaaagacagtaccttgatcatgcagcttcttcgtgacaatctcactctctggacatctgatatgcaggatgatgctgcggatgagatcaaggaagcagcagcgccaaaaccgaccgaggaacagcagtgatcttttgagtgaaactgctagttttcttctagggtttggaatttcttctctttctcgtccatatgtttttcttaatccatctaagaggtcgctcttgccatttcgctcatcttcaaaagcttattcattcatcatatttgtggcaagtctgaaccatcaatcatctttttatctctttttaatttattttctcttttcttatttctttgttgttatcgatttcaatgtctgtgtaatcgaaacttgctttcttttctcatcaatttgaagatcataaagtctcttgtctcttatcttgttgcgtagattgattgtttatcaatttttaatttt

SEQ ID NO: 2528 - protein, 259 aa, Arabidopsis thaliana
  G537,GF14 domain coordinates 1-259
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 2529 - DNA, 890 bp, Arabidopsis thaliana
  G545,family:Z-C2H2
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 2530 - protein, 227 aa, Arabidopsis thaliana
  G545,Z-C2H2 domain coordinates 82-102,136-154
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 2531 - DNA, 1832 bp, Arabidopsis thaliana
  G554,family:bZIP
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 2532 - protein, 367 aa, Arabidopsis thaliana
  G554,bZIP domain coordinates 82-142
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 2533 - DNA, 1360 bp, Arabidopsis thaliana
  G555,family:bZIP
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 2534 - protein, 330 aa, Arabidopsis thaliana
  G555,bZIP domain coordinates 38-110
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 2535 - DNA, 842 bp, Arabidopsis thaliana
  G557,family:bZIP
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 2536 - protein, 168 aa, Arabidopsis thaliana
  G557,bZIP domain coordinates 35-47,78-157
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 2537 - DNA, 1413 bp, Arabidopsis thaliana
  G561,family:bZIP
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 2538 - protein, 360 aa, Arabidopsis thaliana
  G561,bZIP domain coordinates 248-308
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 2539 - DNA, 978 bp, Arabidopsis thaliana
  G578,family:bZIP
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 2540 - protein, 325 aa, Arabidopsis thaliana
  G578,bZIP domain coordinates 36-96
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 2541 - DNA, 2162 bp, Arabidopsis thaliana
  G584,family:HLH/MYC
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 2542 - protein, 589 aa, Arabidopsis thaliana
  G584,HLH/MYC domain coordinates 409-466
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 2543 - DNA, 1200 bp, Arabidopsis thaliana
  G589,family:HLH/MYC
aaaaaaacagaagccatgaactcctcgtctcttctaactccttcatcatctccttctccacatcttcaatctcctgcaacattcgaccacgatgatttcctccaccacatcttctcctccactccttggccctcatccgttctcgacgacactcctccaccaacttccgattgtgcccccgtcactggattccaccaccacgacgccgattcaagaaaccagatcactatgattcctttgtcacataaccatcctaatgacgctctcttcaatggcttctccaccggatctctccctttccacctccctcaaggatcgggaggtcaaacgcaaacgcagtcgcaggcgacggcgtcagccaccaccggtggtgcaacggcgcaacctcagacaaagcctaaagtccgagctaggagaggtcaagccactgatcctcacagtatcgccgaacggttacggagagagaggatagcggaaagaatgaaatctcttcaagaacttgtccctaatggtaacaagacagacaaagcatcaatgctcgatgagattatcgattatgtcaagttcttacagctccaagtcaaggtactaagcatgagtagactgggcggtgctgcttctgcttcttctcaaatctctgaggatgccggtggatcccacgaaaacacctcctcctccggcgaggcgaagatgacggagcaccaagttgcaaagctaatggaagaggacatgggatcagccatgcaatatctacaaggcaaaggtctttgcctcatgcccatctcgttagccaccaccatctccaccgccacgtgtccttctcgtagccccttcgttaaagataccggcgttcctttgtctcctaacctatccactacaatagttgctaacggtaatggctcatcgttggtcaccgttaaagacgctccctccgtttccaagccgtgataacggccatttgtccatttcattttcccttttttgggtgggaaagagagaaaaaagtttagaagacaaagacaagtgggataggtggttttggtcaaagtttagaaagaataaggtcgtgttttcggatacgacaccgtatttgcgtacactttggttttctgtctttacctactacaaaccacccataagcacactcatgttatcatgtttttttttttttggtttataaagatataaaaaaaaaaaaaa

SEQ ID NO: 2544 - protein, 310 aa, Arabidopsis thaliana
  G589,HLH/MYC domain coordinates 133-190
MNSSSLLTPSSSPSPHLQSPATFDHDDFLHHIFSSTPWPSSVLDDTPPPTSDCAPVTGFHHHDADSRNQITMIPLSHNHPNDALFNGFSTGSLPFHLPQGSGGQTQTQSQATASATTGGATAQPQTKPKVRARRGQATDPHSIAERLRRERIAERMKSLQELVPNGNKTDKASMLDEIIDYVKFLQLQVKVLSMSRLGGAASASSQISEDAGGSHENTSSSGEAKMTEHQVAKLMEEDMGSAMQYLQGKGLCLMPISLATTISTATCPSRSPFVKDTGVPLSPNLSTTIVANGNGSSLVTVKDAPSVSKP

SEQ ID NO: 2545 - DNA, 1157 bp, Arabidopsis thaliana
  G593,family:HLH/MYC
cgtcctaatgtatccttctctcgacgatgatttcgtctctgatttgttttgcttcgatcaaagggggaaaggttgtgtcttttgatgataatttgacgaaccctaatgtatctgaaagctgttaaattgaataggagaagaagtagctttatggatgttgttgtttatatttactcctattgatggatgtgaatctttttggtcatgatgactcttgtagcaatggagcagaacttgatgattacacacagtttggtgtaaatttgcagactgatcaagaggatacctttccagattttgtgtcatatggtgtgaatttgcagcaggagccagatgaagtctttagtattggagcttctcaattggatttgtcctcgtataatggagttttgtcgctagagccagaacaggtggggcaacaagattgtgaagttgtgcaggaagaagaagtagagatcaattctggttcatctggtggagctgttaaggaagaacaggaacatttagatgacgattgctccagaaagcgggcaaggactggatcgtgtagcagaggaggaggaactaaagcgtgtcgtgaaaggttgaggagggagaagctaaatgagaggtttatggatttgagctcggttttggagcctgggaggactcctaagactgataaaccggctatactcgatgatgcaatccgtatattgaatcaacttagagatgaagctcttaagcttgaagaaactaaccagaagcttttagaggagatcaagagtctcaaggcggagaagaacgagctgagggaggaaaagctggtgttgaaggcggataaagagaagacagaacaacagttaaagtctatgacggctccatcttcagggttcatacctcatattccagctgcatttaaccacaacaaaatggctgtttatccaagttacggttacatgccaatgtggcattatatgcctcaatccgttcgtgacacatctcgtgatcaagaactcaggcctcctgctgcttaaactctcaattgtttttttttggtacccatagggaactcatagagatttctgaatcacttggtttaggattcttccgtttggcaagtgtaaaagctttactcttgatcttgggttgtatttttcttataaaataaatataac

SEQ ID NO: 2546 - protein, 277 aa, Arabidopsis thaliana
  G593,HLH/MYC domain coordinates NA
MDVNLFGHDDSCSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 2547 - DNA, 720 bp, Arabidopsis thaliana
  G602,family:DBP
ataaaatctgttcttcttcttcggctgagagacaatggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaagcctttattgaatttgtatctttgtaacaattcatctctgtttctttcttcttcttttgtttttgtgtgattcaacaactctttttagtttttgttatttgtttggaaaaaaa

SEQ ID NO: 2548 - protein, 190 aa, Arabidopsis thaliana
  G602,DBP domain coordinates 110-162
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 2549 - DNA, 1263 bp, Arabidopsis thaliana
  G605,family:AT-hook
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 2550 - protein, 334 aa, Arabidopsis thaliana
  G605,AT-hook domain coordinates 72-80,150-265
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 2551 - DNA, 1242 bp, Arabidopsis thaliana
  G617,family:TEO
cagatctgttctttacaccaaattgagtactgaagatcttgttgagtgaattaaagagatgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttgaatgattttatatatctacactatacattgaaaatgttatatgtatacgtattcttctatattttgatatatatgcgtattgttggattggtttatgtatct

SEQ ID NO: 2552 - protein, 360 aa, Arabidopsis thaliana
  G617,TEO domain coordinates 64-118
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 2553 - DNA, 1564 bp, Arabidopsis thaliana
  G618,family:TEO
cagataacgaccatttcttagattctccgtcgccgcctcttctagagatgagacaccaccaatcagcgacggagaacggtggtggttgcggagagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcgtttctttatgttcttgtgttggaaacctttaaccccacttgaagctaaagtcttttgtttgccctttaaaaaaaaaaaaaaaaa

SEQ ID NO: 2554 - protein, 373 aa, Arabidopsis thaliana
  G618,TEO domain coordinates 32-89
MRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 2555 - DNA, 826 bp, Arabidopsis thaliana
  G620,family:CAAT
gaattgaacttggaccagcacagcaacaacccaaccccaatgaccagctcagtcatagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagaaggagttattcttcatttttatatctattcaaaacatgtgtttcgatagatattttatttttatgtcttatcaataacatttctatataatgttgcttctttaaggaaaagtgttgtatgtcaatactttatgagaaactgatttatatatgcaaat

SEQ ID NO: 2556 - protein, 208 aa, Arabidopsis thaliana
  G620,CAAT domain coordinates 28-117
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 2557 - DNA, 699 bp, Arabidopsis thaliana
  G627,family:MADS
atggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttttaactatatga

SEQ ID NO: 2558 - protein, 219 aa, Arabidopsis thaliana
  G627,MADS domain coordinates 1-57
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 2559 - DNA, 1557 bp, Arabidopsis thaliana
  G629,family:bZIP
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 2560 - protein, 368 aa, Arabidopsis thaliana
  G629,bZIP domain coordinates 92-152
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 2561 - DNA, 1553 bp, Arabidopsis thaliana
  G632,family:TH
ctttttttcattttgttctgagggggcttttgtgttgacggtggtgggaacaaaggaacatcgtatccattctgtccgggaaacacagcaatgttcatttccgacaaatctcgtcctactgatttctacaaagacgatcatcacaattcctccaccaccagcaccacacgcgatatgatgatcgatgtactcaccactaccaacgaatcagtagatctacaatctcaccaccaccacaatcaccacaatcatcatctccaccaatctcagccacaacaacagattctcctcggagaaagcagtggagaagatcacgaagttaaagcaccaaagaaacgagcggagacatgggttcaagacgaaactcgtagcttaatcatgttccgtagaggtatggatggtttattcaatacatccaaatctaataaacatctctgggaacagatttcgtctaagatgagagaaaaagggtttgatcgatctccgactatgtgtactgataaatggaggaatctgttgaaagagtttaagaaagctaagcatcatgatagaggaaatggatcggcgaagatgtcgtattacaaagagattgaagatattcttagagagaggagcaaaaaagtgacaccaccacagtataataagagccctaatacaccacctacatcagccaaagttgattcctttatgcaatttactgataaaggttttgatgatacgagcatttcttttggatccgttgaagctaatggcaggccagccttaaaccttgaaaggcgtcttgatcatgatggtcatcctcttgcaatcactacagcagttgatgctgttgcagcaaatggagttactccttggaattggagagagactcctggaaacggtgatgatagtcatggtcagccttttggtggtagggtcataacagtgaaatttggtgactatacaagaagaatcggtgttgatggtagtgcagaagcaatcaaagaggtaatcagatctgcttttgggttaagaactcgaagggctttttggttagaagatgaagatcagattattcgctgtcttgaccgagacatgcccttagggaactatctactccgtctggatgatggactggccattagggtttgccattatgatgaatccaaccaattaccagtccattcagaagagaaaatcttctacactgaagaagactaccgcgagtttctggctctacagggatggtcaagcctgcaagttgatggttttaggaacatagaaaacatggatgatcttcaacctggtgctgtgtatcgaggtgtgagatgaggaaatgagatcacaaaacttcttctccaattctatcaacagttatctgaacagaaaacagtcccctgtagatatgatctcattctctttatacatttcttctttttttcatgtacttgctcaaatatgaaatatcataactggcatttaccgtacagaccaagaagacctcaaaatagatttttggtctgttacatttgtaagaacagaacataagagaagtgaataaattgttcacaatc

SEQ ID NO: 2562 - protein, 406 aa, Arabidopsis thaliana
  G632,TH domain coordinates 70-160
MFISDKSRPTDFYKDDHHNSSTTSTTRDMMIDVLTTTNESVDLQSHHHHNHHNHHLHQSQPQQQILLGESSGEDHEVKAPKKRAETWVQDETRSLIMFRRGMDGLFNTSKSNKHLWEQISSKMREKGFDRSPTMCTDKWRNLLKEFKKAKHHDRGNGSAKMSYYKEIEDILRERSKKVTPPQYNKSPNTPPTSAKVDSFMQFTDKGFDDTSISFGSVEANGRPALNLERRLDHDGHPLAITTAVDAVAANGVTPWNWRETPGNGDDSHGQPFGGRVITVKFGDYTRRIGVDGSAEAIKEVIRSAFGLRTRRAFWLEDEDQIIRCLDRDMPLGNYLLRLDDGLAIRVCHYDESNQLPVHSEEKIFYTEEDYREFLALQGWSSLQVDGFRNIENMDDLQPGAVYRGVR

SEQ ID NO: 2563 - DNA, 606 bp, Arabidopsis thaliana
  G652,family:Z-CLDSH
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 2564 - protein, 201 aa, Arabidopsis thaliana
  G652,Z-CLDSH domain coordinates 28-49,137-151,182-196
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 2565 - DNA, 861 bp, Arabidopsis thaliana
  G654,family:Z-LIM
gtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttaaggagaagggaagttacaaccacttaatcaaatccgcttccatcaaacgcttcgcagccgcagcagtcgccgccggtgtaccagcagcctccgttcctgaatcttaaaatccaataatttctcctctctagtctaaaatttgaagttaatgccaaactgattcagtttgattctctttgtgagagcgtgtgtgtaatctatgcttgatgttcttatttccattgatgtctcctaaaaatctatgtttgtgtggtgtttggttatctataaaaagtctgaaactttccttataaa

SEQ ID NO: 2566 - protein, 172 aa, Arabidopsis thaliana
  G654,Z-LIM domain coordinates 10-61,108-159
MSFTGTQQKCKACEKTVYAVELLSADGVGYHKSCFKCTHCKSRLQLSSYSSMEGVLYCKPHFEQLFKESGSFNKNFQSPAKSADKSTPELTRTPSRVAGRFSGTQEKCATCSKTVYPIEKVTVESQTYHKSCFKCSHGGCPISPSNYAALEGILYCKHHFAQLLRRREVTTT

SEQ ID NO: 2567 - DNA, 1056 bp, Arabidopsis thaliana
  G668,family:MYB-(R1)R2R3
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 2568 - protein, 351 aa, Arabidopsis thaliana
  G668,MYB-(R1)R2R3 domain coordinates 14-115
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 2569 - DNA, 1307 bp, Arabidopsis thaliana
  G670,family:MYB-(R1)R2R3
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 2570 - protein, 374 aa, Arabidopsis thaliana
  G670,MYB-(R1)R2R3 domain coordinates 14-122
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 2571 - DNA, 1369 bp, Arabidopsis thaliana
  G678,family:MYB-(R1)R2R3
ggttgtgtcgtcactttacttctctttaaataatctctttctctagtgattgactttaggaacaagtgaagtgagtgatttttaataatcgccggccgagagaatgggaagggcgccgtgctgtgagaaggtaggaattaagaaggggcgctggacggcggaggaagaccggactctctccgactacattcagtccaacggcgaaggatcatggcgttctcttcccaaaaatgccgggctaaagagatgtggaaagagctgtagattgagatggataaactatttgagatcagacatcaagagaggaaacataactcccgaagaagaggacgtcattgttaaactgcattccactttgggaaccaggtggtcaacaattgcgagcaatctaccgggaagaacagacaacgaaataaaaaactattggaattctcatctcagccgtaaactccacggttacttcagaaaaccaactgtcgccaataccgtcgagaatgcgcctccgcctcctaagcgtagacctggaagaaccagcagatccgccatgaaacccaaatttatcctaaaccctaaaaaccacaaaacccctaattcttttaaagcaaacaaaagtgacatcgttttgccaactacgacaatagagaatggagagggagacaaagaagacgcattaatggtgttgtcaagtagtagcttaagtggagcagaggaacccggtttaggaccatgtggttatggagacgatggcgattgtaacccaagcattaatggcgacgatggagctttgtgtctcaatgacgacattttcgattcttgttttctattggacgactctcatgctgtccacgtgtcctcatgtgagtcgaacaacgtaaaaaactctgagccatatggagggatgtcagttgggcacaaaaatatcgaaacgatggctgatgatttcgttgactgggactttgtatggagagaaggtcaaaccctttgggacgaaaaagaggatcttgattcggttttgtcgaggctgttagatggagaggaaatggaatctgagatcagacaaagggactccaacgactttggagaaccgttggatattgacgaagaaaacaagatggctgcttggcttttttccttaaaaattttacccccttccttttcccttttccccctttaatttttaccaaaacccccccttgccagatcctgtccgtttttccattaaacctttttctccccctaccttcctttttttatttttaattttttttttttcctttttttttcctttccttttttaattccgatttttggcgggttgccaattaaccaaattaaatccatccttaaaaaaaaaaaaaaaaaaaaaaaa

SEQ ID NO: 2572 - protein, 356 aa, Arabidopsis thaliana
  G678,MYB-(R1)R2R3 domain coordinates 14-115
MGRAPCCEKVGIKKGRWTAEEDRTLSDYIQSNGEGSWRSLPKNAGLKRCGKSCRLRWINYLRSDIKRGNITPEEEDVIVKLHSTLGTRWSTIASNLPGRTDNEIKNYWNSHLSRKLHGYFRKPTVANTVENAPPPPKRRPGRTSRSAMKPKFILNPKNHKTPNSFKANKSDIVLPTTTIENGEGDKEDALMVLSSSSLSGAEEPGLGPCGYGDDGDCNPSINGDDGALCLNDDIFDSCFLLDDSHAVHVSSCESNNVKNSEPYGGMSVGHKNIETMADDFVDWDFVWREGQTLWDEKEDLDSVLSRLLDGEEMESEIRQRDSNDFGEPLDIDEENKMAAWLFSLKILPPSFSLFPL

SEQ ID NO: 2573 - DNA, 965 bp, Arabidopsis thaliana
  G713,family:HB
ggcacgagccttctctcttaatcaaaatcaagaaacttacaagatctggtgaaaaccatggaagaaggagattttttcaactgctgtttcagcgagattagtagtggcatgaccatgaataagaagaagatgaagaagagcaataaccaaaagaggtttaacgaggaacagatcaagtcacttgagcttatatttgagtctgagacgaggcttgagccgaggaagaaggttcaggtagctagagagctagggctgcaaccaagacaaatgactatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttagggtccagggagagactgatcatgagctgatgaacattgtggagaaagctgatgatagttgcttgacatcttctgagaattggggaggtttcaattctgattctctcttagaccaatctagcagcaattaccctaactggtgggagttttggtcataaaagcatataagaaaaaaacagaacataagcgaagagaaagagtgtgaatagtttgtaaattatgtgttaagaaaataaatttagtttagtttaaatcttgtttcgatctatgtatctactatgttcaatactctttgtagctaattagtagcttataatgagactagaaaagttttgaagtcaaaaaaaaaaaaaaaaaa

SEQ ID NO: 2574 - protein, 235 aa, Arabidopsis thaliana
  G713,HB domain coordinates 23-86
MEEGDFFNCCFSEISSGMTMNKKKMKKSNNQKRFNEEQIKSLELIFESETRLEPRKKVQVARELGLQPRQMTIWFQNKRARWKTKQLEKEYNTLRANYNNLASQFEIMKKEKQSLVSELQRLNEEMQRPKEEKHHECCGDQGLALSSSTESHNGKSEPEGRLDQGSVLCNDGDYNNNIKTEYFRVQGETDHELMNIVEKADDSCLTSSENWGGFNSDSLLDQSSSNYPNWWEFWS

SEQ ID NO: 2575 - DNA, 2299 bp, Arabidopsis thaliana
  misc_feature (32)..(33): n is a, c, g, or t
  misc_feature (37)..(37): n is a, c, g, or t
  misc_feature (45)..(45): n is a, c, g, or t
  misc_feature (62)..(62): n is a, c, g, or t
  misc_feature (76)..(76): n is a, c, g, or t
  misc_feature (122)..(122): n is a, c, g, or t
  misc_feature (151)..(151): n is a, c, g, or t
  G716,family:ARF
aaaaaaaaaggggagagatttagttttatccnncagngcctgaantacgttctgcaatcaanacggacataaccgnccgttgtgtcctgtttataaagttttgctttttttattttctccantgatgggtcttttctttcttctctctctngtgtttctttcatggggttaagactagtgtttaccgcgtgaaggtttttttttctttctattttctttcatttcctctccttctacttcttcttctccagttctcatctgggttcttcaatggcgagtgttgaaggtgatgatgatttcggaagttcttcgtcaaggtcttatcaagatcaactatacacagagctatggaaagtttgtgcaggtccattagtggaagttcctcgtgctcaagagagagttttctacttccctcagggtcacatggaacaacttgtggcgtcaactaatcaaggaatcaattcagaagaaatacctgtttttgatcttcctccaaagatactttgtcgagttcttgatgtcactttaaaggcggagcatgaaacagatgaggtttacgctcagatcacattacaaccagaggaagatcaaagtgaaccaacaagtcttgatccacctattgttggaccaactaagcaagagtttcattcgtttgttaagattttaacggcttcagatacaagcactcatggtggattctctgttcttcgtaaacacgccactgaatgcttgccttctttggatatgacacaagctactcctactcaagaacttgtgactagagatcttcatggctttgaatggaggtttaagcatatattcagaggacaaccacggaggcatttgcttactacgggttggagtacatttgtatcctcgaaaagacttgtagctggagatgcttttgtgttcttgaggggtgagaatggggatttacgggttggagtgagacgattagctcggcatcaaagcacaatgcctacttcggttatttcaagtcagagcatgcatttgggagttcttgctacagcttctcatgctgtgcgtacaacaacaatctttgttgtcttttacaagcctaggataagccaattcatagttggggtgaacaagtatatggaagctataaagcatggattttctctcggtacccgattcagaatgaggtttgaaggagaagagtctcctgagagaatatttactggtacgattgtgggaagtggagatctatcttcacaatggccagcttctaaatggaggtcattgcaggtacaatgggatgagccaacaacagttcagagaccagataaagtctcaccatgggagatagagcctttcttggcaacttccccaatttcaactcctgctcaacaaccacaatcgaaatgcaagcggtcaagacccatcgagccatcagttaaaacaccagccccacctagtttcttgtacagcctccctcagagccaagattccattaatgcatcccttaaactgtttcaagatccatcacttgagagaatttcaggtggatactcctcaaacaacagcttcaaacccgagactcctcctcctccaacgaattgtagctataggttgtttggatttgatctcacaagcaattctcctgctccaatccctcaagacaagcaaccgatggatacttgtggagctgccaagtgtcaagaacccatcactccaacctcaatgagtgagcagaagaagcaacaaacatcaagaagtcgaactaaagtgcaaatgcaaggcattgcggttggtcgtgcggttgatttaacactgttgaaatcttacgatgaactgattgatgagcttgaggagatgtttgagattcaaggacagcttcttgcccgagacaaatggatcgttgtcttcactgatgatgaaggagatatgatgcttgctggtgatgatccgtggaatgagttttgcaagatggcaaagaagatatttatatattcgagcgatgaggttaagaaaatgacaacgaaactgaagatttcttcgtcgttagagaatgaggaatatggtaatgaatcattcgaaaatcgtagtagggggtgagagttttagctgttaattaaggttaattcggcgacgtcgttttagtgcgtaagtgtctaaagactttttttttagtctgtgtatataaagtcttgtcctctttttcatgtcaatttttcaagttggcgatttaatatttcggttttgggacagtggttgatggggcggttttacattttttatgtgtatgtacttgttccaaaaccattcaattttcaaa

SEQ ID NO: 2576 - protein, 602 aa, Arabidopsis thaliana
  G716,ARF domain coordinates 24-355
MASVEGDDDFGSSSSRSYQDQLYTELWKVCAGPLVEVPRAQERVFYFPQGHMEQLVASTNQGINSEEIPVFDLPPKILCRVLDVTLKAEHETDEVYAQITLQPEEDQSEPTSLDPPIVGPTKQEFHSFVKILTASDTSTHGGFSVLRKHATECLPSLDMTQATPTQELVTRDLHGFEWRFKHIFRGQPRRHLLTTGWSTFVSSKRLVAGDAFVFLRGENGDLRVGVRRLARHQSTMPTSVISSQSMHLGVLATASHAVRTTTIFVVFYKPRISQFIVGVNKYMEAIKHGFSLGTRFRMRFEGEESPERIFTGTIVGSGDLSSQWPASKWRSLQVQWDEPTTVQRPDKVSPWEIEPFLATSPISTPAQQPQSKCKRSRPIEPSVKTPAPPSFLYSLPQSQDSINASLKLFQDPSLERISGGYSSNNSFKPETPPPPTNCSYRLFGFDLTSNSPAPIPQDKQPMDTCGAAKCQEPITPTSMSEQKKQQTSRSRTKVQMQGIAVGRAVDLTLLKSYDELIDELEEMFEIQGQLLARDKWIVVFTDDEGDMMLAGDDPWNEFCKMAKKIFIYSSDEVKKMTTKLKISSSLENEEYGNESFENRSRG

SEQ ID NO: 2577 - DNA, 1760 bp, Arabidopsis thaliana
  G729,family:GARP
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 2578 - protein, 403 aa, Arabidopsis thaliana
  G729,GARP domain coordinates 224-272
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 2579 - DNA, 2001 bp, Arabidopsis thaliana
  G760,family:NAC
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 2580 - protein, 567 aa, Arabidopsis thaliana
  G760,NAC domain coordinates 12-156
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 2581 - DNA, 1824 bp, Arabidopsis thaliana
  G761,family:NAC
ggggccgaccggccgcccgggcaggtctaggttcaaaaggactcacaagagagagatagtatgattgatagggaaagagagagagatgaaagaaagtaaaatatataatagattattaggacacgagtgtcatcttttgatttgtgtcttgtgtgctctctctttcttctcttcctcgaatgatcatctttatataaccctactctctttctcttttcccattctttcatatcattctccctttctctctcgggatctgatctctctttccagtaacctattcccgaggagcactgtcaaatcttgtccactctttgatcttatctcgatctctttctctttctagtcttgtgtagtcttcaaacttgtgatgttatctatatagtaatcacgagagagaatcatacaatagctgaaacataaagctttcttagaagctttaaaaaggtctcatctggattatcctgtttaatttctagagtttcttcaggcagattattaaccgatcaagaagacaaacatgaattcattttcccacgtccctccgggttttagatttcacccgacagatgaagaacttgtagactactacctgaggaaaaaagtcgcatcgaagagaatagaaattgatttcataaaggacattgatctttacaagattgagccatgggaccttcaagagttgtgcaaaattgggcatgaagagcagagtgattggtacttctttagccataaagacaagaagtatcccacagggactcgaaccaatagagcaacaaaagcagggttttggaaagccaccggaagagataaggctatctatttgaggcatagtctaattggcatgaggaaaacacttgtgttttacaagggaagagccccaaatggacaaaagtctgattggatcatgcacgaataccgcttagaaaccgatgaaaacggaactcctcaggaagaaggatgggttgtgtgtagggttttcaagaagagattggctgcagttagacgaatgggagattacgactcatccccttcacattggtacgatgatcaactttcttttatggcctccgagctcgagacaaacggtcaacgacggattctccccaatcatcatcagcagcagcagcacgagcaccaacaacatatgccatatggcctcaatgcatctgcttacgctctcaacaaccctaacttgcaatgcaagcaagagctagaactacactacaaccacctgcaatcaaatatcgcgcatgaggaacaattgaatcaaggaaatcagaacttcagctctctatacatgaacagcggcaacgagcaagtgatggaccaagtcacagactggagagttctcgataaatttgttgcttctcagctaagcaacgaggaggctgccacagcttctgcatctatacagaataatgccaaggacacaagcaatgctgagtaccaagttgatgaagaaaaagatccgaaaagggcttcagacatgggagaagaatatactgcttctacttcttcgagttgtcagattgatctatggaagtgagctgaaagagaagacatataaatgcatatatacatatatatatatacgtacacacgaacactaatcaagtgtagatgatgatgatggtacagatttatatttgctttgattgattcttactacattattgaacttatgtcatatgcatatatacattgcgtatctatgcatatttatacttgtactcaatatgattaaccatatataaactctaatctaaatgtaactccaatattttttaaatagacaattgtctcttcttattagaaaaaaaa

SEQ ID NO: 2582 - protein, 342 aa, Arabidopsis thaliana
  G761,NAC domain coordinates 10-156
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 2583 - DNA, 905 bp, Arabidopsis thaliana
  G767,family:NAC
cgaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggc

SEQ ID NO: 2584 - protein, 253 aa, Arabidopsis thaliana
  G767,NAC domain coordinates 8-158
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 2585 - DNA, 1107 bp, Arabidopsis thaliana
  G791,family:HLH/MYC
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 2586 - protein, 234 aa, Arabidopsis thaliana
  G791,HLH/MYC domain coordinates 68-127
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 2587 - DNA, 1790 bp, Arabidopsis thaliana
  G807,family:HS
gagagagtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataaagattttcaggggaggttgcaaaaggagatatgaaggaacgaggaatatatcagatggtgtgtataccctttacatttttacttaaatgaaaaaaaaacagagagaagaaacataaaagatttaccaccaagcttgtgaatagttagtagagatcggtttttgtgttgtttatattatacttttgtgtgaaaacgttcatcttgttcaattatcaaaaaaaaaaaaaa

SEQ ID NO: 2588 - protein, 481 aa, Arabidopsis thaliana
  G807,HS domain coordinates 27-118
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 2589 - DNA, 2307 bp, Arabidopsis thaliana
  G820,family:AKR
gggaaagaaagaaacttgactgctaattgctaaaggtaatgcttctgagaattggaagctaatgaagctcttcctcaatagcaatctgctcagaaactctattttcttcaagatctccgcctttgttttgatctccgttgcttgtttcttcctcggtaagcattggtctgaggatggcttccgccgtctcatcttcttctccgccgagccttcccgatctcccattgtcgcactctcacctgatttcggaaaaacctataacatctctggtttgatctatgagagtcacccgattttgcctccgtctttgtcaccaccgccgccgccagattctgttgagttgaaggtgtttggaatcgttaatgagaacggaacaatgtctgatgagtttcagattggtgattacgacgttgagtcggcggagacgttggggaatcagacggaattcgagagtagcgacgacgatgatattaaatccaccacagctagagttagtgtgaggaaatttgagatttgttcggagaatatgactgagtacattccttgtttggataatgtagaagccatcaaaaggcttaattcaacggcgcgtggtgagcgattcgaacggaattgtcctaacgatggaatgggattgaattgcaccgttccgattcctcaaggataccgtagtccgattccgtggccgagaagccgtgatgaggtgtggttcaacaatgttccacatactaaacttgttgaagacaaaggtggtcaaaattggatttataaagagaatgacaaatttaagtttcctggtggtggtactcagtttatacacggagctgatcagtacttggatcagatctctcagatgattcctgatattagctttggtaaccatacacgagttgttcttgacattggatgtggtgtggcaagttttggtgcctacttaatgtcacgaaatgtcttgactatgtctatagctccaaaagatgttcacgagaaccagatacagtttgctcttgagcgtggtgttcctgcaatggtggcagcattcacaacacggagattgttgtatccaagccaagcttttgatttggtacattgttcaagatgtagaatcaactggactcgtgatgatgggatcctgctccttgaagttaataggatgcttcgtgccggaggatattttgtttgggcagcacaacctgtatataagcatgaaaaggccttggaagaacagtgggaagagatgctaaacctgaccactaggctgtgctgggttcttgtaaagaaggaaggatatatagctatctggcagaagcctgtaaataacacttgttacctaagtcgtggtgctggagtcagtcctcctttgtgcaattctgaagatgacccagataatgtttggtacgtggatctgaaggcatgcatcactagaattgaagaaaatggatatggagcaaatcttgctccttggccagctcgtttactgaccccaccggataggctgcagacaatacaaattgattcatacatagcccgaaaagagctatttgtagccgaatcaaagtactggaaagaaataatatcaaactatgtaaatgccctacactggaagcagataggactcagaaatgtcttggacatgagagctggatttggcggatttgcagctgcattagctgagctaaaggttgactgctgggttcttaacgtcatcccagtgagtggtcccaacacattgcctgttatatatgaccgtggactgcttggagttatgcacgattggtgtgaaccttttgatacttacccaagaacctacgatttgctgcatgctgcgggtctgttttccattgaaagaaaaagatgcaacatgacaacaatgatgctagagatggaccggattttaagacctggaggacgtgtatacatacgggacacaatcaatgtaacgagtgagcttcaagagattggaaacgcaatgaggtggcacacgagcttacgtgaaactgctgaaggacctcactcaagttacagggttctcttatgtgagaagcggtttgaatcgtctgagaagcgtcgtaccaagaagaggaggaagactaaaggaaaaagagcttgacattttcatagaatacaagtgctgggctagaattttctggggatctttggatcaatggacaatggttagtttagttgggaggctttttggaattttagaaaaattagggacctgaaacagtgaaactgtttgtgaggttttggcgtttaaccctctttaaagttgattgaaaccggattaaactcacttaacccaaa

SEQ ID NO: 2590 - protein, 682 aa, Arabidopsis thaliana
  G820,AKR domain coordinates 158-661
MKLFLNSNLLRNSIFFKISAFVLISVACFFLGKHWSEDGFRRLIFFSAEPSRSPIVALSPDFGKTYNISGLIYESHPILPPSLSPPPPPDSVELKVFGIVNENGTMSDEFQIGDYDVESAETLGNQTEFESSDDDDIKSTTARVSVRKFEICSENMTEYIPCLDNVEAIKRLNSTARGERFERNCPNDGMGLNCTVPIPQGYRSPIPWPRSRDEVWFNNVPHTKLVEDKGGQNWIYKENDKFKFPGGGTQFIHGADQYLDQISQMIPDISFGNHTRVVLDIGCGVASFGAYLMSRNVLTMSIAPKDVHENQIQFALERGVPAMVAAFTTRRLLYPSQAFDLVHCSRCRINWTRDDGILLLEVNRMLRAGGYFVWAAQPVYKHEKALEEQWEEMLNLTTRLCWVLVKKEGYIAIWQKPVNNTCYLSRGAGVSPPLCNSEDDPDNVWYVDLKACITRIEENGYGANLAPWPARLLTPPDRLQTIQIDSYIARKELFVAESKYWKEIISNYVNALHWKQIGLRNVLDMRAGFGGFAAALAELKVDCWVLNVIPVSGPNTLPVIYDRGLLGVMHDWCEPFDTYPRTYDLLHAAGLFSIERKRCNMTTMMLEMDRILRPGGRVYIRDTINVTSELQEIGNAMRWHTSLRETAEGPHSSYRVLLCEKRFESSEKRRTKKRRKTKGKRA

SEQ ID NO: 2591 - DNA, 2276 bp, Arabidopsis thaliana
  G833,family:AKR
gccagctttatctctctctttttcacatcccatggctagatggtgacgacgattcacgcataaactagggttcccccacaaatcatcttacacgtatcctctattccttccttcctttctccgtcatcatcatttttcccaccgacaacaatctctcggagtttgggtattattacttctctcatcaaccaattgtaccactagatctcccagattccttcattatctctatcaataatggcgttgaagtctagttctgctgatggtaaaaccagaagctctgttcagatcttcattgtgtttagtttatgttgcttcttttacattttgggagcatggcaacgaagtggttttggtaaaggagacagtattgctcttgagatgaccaacagtggagctgattgcaacattgttcctagcttgaatttcgagactcatcacgctggcgaatcaagtcttgttggtgcttctgaagctgcaaaggtcaaggctttcgagccctgtgatggtcgttacacggattacactccttgtcaagatcagagacgtgccatgactttcccgagagatagtatgatttaccgagaaaggcattgcgctcctgagaatgagaagctccattgtcttataccggctcctaaaggatatgtgacacctttctcttggcctaagagtcgagactatgtgccttatgctaatgcgccgtataaagcattgactgttgagaaggctattcagaattggattcagtatgagggagacgtttttagattccctggtggtggaactcagttccctcaaggtgctgataagtatatcgatcagcttgcttccgtgatacctatggagaacggaactgttaggactgctttggacactggttgtggggttgcaagttggggagcgtacttatggagcagaaatgtgcgtgcaatgtcttttgcaccaagagattcacacgaggctcaggtccagtttgctctcgagagaggtgttcccgctgttattggtgttcttggtaccataaagttgccatacccaacacgtgctttcgacatggctcattgctctcggtgtttgattccatggggagcaaatgatgggatgtacttgatggaagttgaccgtgtgcttagacctggtgggtactggattctgtctggtcctccaatcaactggaaagtcaactacaaggcatggcaacgtcccaaggaggaccttcaagaggaacaaagaaagattgaggaagctgctaaacttctttgttgggagaaaaagtatgaacacggtgagattgcaatttggcagaagagagtcaatgatgaggcatgccgatcaagacaagatgatcctagagccaatttctgcaaaaccgatgataccgatgatgtctggtacaagaaaatggaggcatgtattacaccgtatccggagacaagtagctcagatgaagtagctggtggtgagcttcaggctttcccagataggctcaatgcagtgccgcccaggatctctagcggttcgatctctggtgttactgttgatgcctatgaagacgataacagacagtggaaaaaacatgtgaaagcctacaagagaatcaacagtctacttgacactggaaggtaccgtaacatcatggacatgaacgcagggtttggtggatttgctgctgctcttgaatcccaaaagctttgggttatgaatgttgttcccacaattgccgaaaagaacagactcggagttgtatatgaacgaggactcatcggtatctaccatgactggtgtgaggctttctctacatatccaagaacatatgacctgatccacgcgaaccacctcttcagtctatacaagaacaagtgcaatgcggatgatattcttctagagatggatagaattctccgaccagaaggagcggttataatccgggatgatgtggatacattgatcaaggtgaagagaatcatcgcttggaatgagatgggatgcgaagcttgtcgatcatgaggatggtcctttagttcctgagaaggttttgattgccgtgaagcagtattgggtcaccaactccacctcgactcactgaagttactttatttccggtgtgacctgacattttgatcaaatgatagagctttcgtccttagggaatgtgagagagctgcaaatcttgtctttaaacactttttgaagtatctatttattgatgttatagtttatttttgtttcccaatccaaaagcttggaactttgtggtgtaccattgaattctc

SEQ ID NO: 2592 - protein, 590 aa, Arabidopsis thaliana
  G833,AKR domain coordinates 95-590
MALKSSSADGKTRSSVQIFIVFSLCCFFYILGAWQRSGFGKGDSIALEMTNSGADCNIVPSLNFETHHAGESSLVGASEAAKVKAFEPCDGRYTDYTPCQDQRRAMTFPRDSMIYRERHCAPENEKLHCLIPAPKGYVTPFSWPKSRDYVPYANAPYKALTVEKAIQNWIQYEGDVFRFPGGGTQFPQGADKYIDQLASVIPMENGTVRTALDTGCGVASWGAYLWSRNVRAMSFAPRDSHEAQVQFALERGVPAVIGVLGTIKLPYPTRAFDMAHCSRCLIPWGANDGMYLMEVDRVLRPGGYWILSGPPINWKVNYKAWQRPKEDLQEEQRKIEEAAKLLCWEKKYEHGEIAIWQKRVNDEACRSRQDDPRANFCKTDDTDDVWYKKMEACITPYPETSSSDEVAGGELQAFPDRLNAVPPRISSGSISGVTVDAYEDDNRQWKKHVKAYKRINSLLDTGRYRNIMDMNAGFGGFAAALESQKLWVMNVVPTIAEKNRLGVVYERGLIGIYHDWCEAFSTYPRTYDLIHANHLFSLYKNKCNADDILLEMDRILRPEGAVIIRDDVDTLIKVKRIIAWNEMGCEACRS

SEQ ID NO: 2593 - DNA, 1782 bp, Arabidopsis thaliana
  G852,family:SCR
atggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaa

SEQ ID NO: 2594 - protein, 593 aa, Arabidopsis thaliana
  G852,SCR domain coordinates 299-364,427-515,519-592
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 2595 - DNA, 1036 bp, Arabidopsis thaliana
  misc_feature (1012)..(1012): n is a, c, g, or t
  G859,family:MADS
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 2596 - protein, 196 aa, Arabidopsis thaliana
  G859,MADS domain coordinates 1-57
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 2597 - DNA, 1210 bp, Arabidopsis thaliana
  misc_feature (1194)..(1196): n is a, c, g, or t
  G860,family:MADS
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 2598 - protein, 240 aa, Arabidopsis thaliana
  G860,MADS domain coordinates 2-57
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 2599 - DNA, 1134 bp, Arabidopsis thaliana
  G861,family:MADS
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 2600 - protein, 240 aa, Arabidopsis thaliana
  G861,MADS domain coordinates 2-57
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 2601 - DNA, 1747 bp, Arabidopsis thaliana
  G864,family:AP2
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 2602 - protein, 343 aa, Arabidopsis thaliana
  G864,AP2 domain coordinates 119-181
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 2603 - DNA, 1281 bp, Arabidopsis thaliana
  G867,family:AP2
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 2604 - protein, 344 aa, Arabidopsis thaliana
  G867,AP2 domain coordinates 59-124,184-276
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 2605 - DNA, 1068 bp, Arabidopsis thaliana
  G899,family:Z-CO-like
atgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcagttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctga

SEQ ID NO: 2606 - protein, 355 aa, Arabidopsis thaliana
  G899,Z-CO-like domain coordinates NA
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 2607 - DNA, 1246 bp, Arabidopsis thaliana
  G9,family:AP2
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 2608 - protein, 352 aa, Arabidopsis thaliana
  G9,AP2 domain coordinates 62-127,184-277
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 2609 - DNA, 1673 bp, Arabidopsis thaliana
  G903,family:Z-C2H2
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 2610 - protein, 466 aa, Arabidopsis thaliana
  G903,Z-C2H2 domain coordinates 68-92
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 2611 - DNA, 480 bp, Arabidopsis thaliana
  G911,family:RING/C3H2C3
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 2612 - protein, 159 aa, Arabidopsis thaliana
  G911,RING/C3H2C3 domain coordinates 86-129
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 2613 - DNA, 724 bp, Arabidopsis thaliana
  G912,family:AP2
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 2614 - protein, 224 aa, Arabidopsis thaliana
  G912,AP2 domain coordinates 51-118
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 2615 - DNA, 890 bp, Arabidopsis thaliana
  G913,family:AP2
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 2616 - protein, 232 aa, Arabidopsis thaliana
  G913,AP2 domain coordinates 62-128
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 2617 - DNA, 1053 bp, Arabidopsis thaliana
  G925,family:ABI3/VP-1
cgctctctccttatactctccattcgctctctctctttcgctttctatctcctagaaaaaatgtcagtcaaccattactccacagaccaccaccacactctcttgtggcagcaacagcaacaccgccacaccaccgacacatcggagacaaccaccaccgccacatggctccacgacgacctaaaagagtcactcttcgagaagtctctcacaccaagcgacgtcgggaaactcaaccgcctcgtcataccaaaacaacacgcagagaaatacttccctctcaatgccgtcctagtctcctctgctgctgctgacacgtcatcttcggagaaagggatgcttctaagctttgaagacgagtcaggcaagtcatggaggttcagatactcttactggaacagcagtcaaagctatgtcttgactaaaggatggagcagatttgtcaaagacaaacagctcgatccaggcgacgttgttttcttccaacgacaccgttctgattctaggagactcttcattggctggcgcagacgtggacaaggctcctcatcctccgtcgcggccactaactccgccgtgaatacgagttctatgggagctctttcttatcatcaaatccacgccactagtaattactctaatcctccctctcactcagagtattcccactatggagccgccgtagcaacagcggctgagactcacagcacaccgtcgtcttccgtcgtcgggagctcaaggacggtgaggcttttcggtgtgaatctggagtgtcaaatggatgaaaacgacggagatgattctgttgcagttgccaccaccgttgaatctcccgacggttactacggccaaaacataatatagctttcacgggagaacgatgaaggagcagagagataagacgaggatgagagatccaaagaagtgacaacattttcggaattgacttaaagctttatgggaccagactttgtagccacataggccaattttctggaaaattgtatgctatttttaataatatctcattagcttccgtactgtatgtaacta

SEQ ID NO: 2618 - protein, 267 aa, Arabidopsis thaliana
  G925,ABI3/VP-1 domain coordinates 42-143
MSVNHYSTDHHHTLLWQQQQHRHTTDTSETTTTATWLHDDLKESLFEKSLTPSDVGKLNRLVIPKQHAEKYFPLNAVLVSSAAADTSSSEKGMLLSFEDESGKSWRFRYSYWNSSQSYVLTKGWSRFVKDKQLDPGDVVFFQRHRSDSRRLFIGWRRRGQGSSSSVAATNSAVNTSSMGALSYHQIHATSNYSNPPSHSEYSHYGAAVATAAETHSTPSSSVVGSSRTVRLFGVNLECQMDENDGDDSVAVATTVESPDGYYGQNII

SEQ ID NO: 2619 - DNA, 821 bp, Arabidopsis thaliana
  G926,family:CAAT
atgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataata

SEQ ID NO: 2620 - protein, 272 aa, Arabidopsis thaliana
  G926,CAAT domain coordinates 172-229
MQSKPGRENEEEVNNHHAVQQPMMYAEPWWKNNSFGVVPQARPSGIPSNSSSLDCPNGSESNDVHSASEDGALNGENDGTWKDSQAATSSRSVDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 2621 - DNA, 1519 bp, Arabidopsis thaliana
  G932,family:MYB-(R1)R2R3
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 2622 - protein, 335 aa, Arabidopsis thaliana
  G932,MYB-(R1)R2R3 domain coordinates 14-118
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 2623 - DNA, 2057 bp, Arabidopsis thaliana
  G940,family:EIL
ttcccctgagaacgacaggagaaagaataaaaaccctaaatttctttaatttcggcgcttcagattatcgttgttaaaggtttttgattgattttgtttaaatgggcgatcttgctatgtccgtagcagacatcaggatggagaatgagcctgatgatttagctagtgataatgttgctgagattgatgtgagtgatgaagagattgatgctgacgaccttgagagacggatgtggaaagatcgtgtcaggcttaaaagaatcaaagagcgacaaaaagctggctctcaaggagctcaaacgaaggagacacctaagaaaatctctgatcaagctcagaggaagaaaatgtctagagctcaagatggtatccttaagtacatgttgaagcttatggaagtctgcaaagttcgcgggtttgtctatggtataataccggaaaagggcaagcctgtgagtggttcctctgacaatataagagcttggtggaaagagaaagtgaagtttgataagaacggtcctgctgctattgctaaatacgaagaggagtgtttagcgtttgggaaatctgatgggaataggaattcacagtttgttctccaggatttgcaagatgctactttagggtctttgttatcttctttgatgcaacattgtgatcctcctcaaaggaagtatccgttggagaaagggacgcctccgccttggtggccaacggggaatgaagaatggtgggtgaaactcggtctgcctaaaagccagagtcctccttaccgaaaacctcatgatctcaagaagatgtggaaggttggagttttaacggcagtgatcaatcatatgttacctgatattgcaaagattaagaggcatgttcgtcagtcgaaatgtttacaggacaagatgacagctaaagagagtgcgatttggttggcggttttgaaccaagaggaatctttgattcagcagcctagcagtgacaatggaaactccaatgtgactgagacacatcgtaggggtaataacgctgacaggaggaaacctgtggtcaacagtgacagtgactatgatgttgatgggacagaggaagcttcaggttcagtttcatctaaagacagtagaagaaatcagattcaaaaagaacaaccaacagccatctcacattcagtaagagatcaagataaagcagagaaacatcgcagaaggaaaagacctcgaattagatccggaactgtcaatcgacaagaggaagaacaacctgaagctcaacaaagaaacatcttacctgatatgaatcatgttgatgcccctctgctagaatataacatcaacggtactcatcaagaggacgatgttgtcgacccaaatattgccttaggaccagaggataatggtctggaactagtggttcctgagttcaataacaactatacttatcttccacttgttaatgaacaaactatgatgcctgtagacgaaaggccaatgctttatggaccaaaccctaaccaagagcttcaatttgggtcagggtacaacttctacaatccctctgcagtgtttgtacataaccaggaagacgacattctccatacacagatagaaatgaatacacaagcaccacctcacaacagtgggttcgaggaggccccaggaggagtacttcaaccccttggtttactcggaaatgaagacggtgtaacagggagtgagttgcctcagtatcagagtggcattctgtctccattgactgacttggactttgactatggtggttttggtgatgatttctcatggtttggagcttagtgtcttgccattttttttgggagattacatagttcaaaaggacatggcaatagtctggctagtacagttactttctcttcttcatttcttctgatcttatattcttcctctttttttcttataatattttcttagatttgttaagagaaacaattttccttttgaataagttgccagaagaactgctttgcccgttgtaatggtctctagggaaagcagttagcgtatcatcatttgtaaatttactgtgag

SEQ ID NO: 2624 - protein, 567 aa, Arabidopsis thaliana
  G940,EIL domain coordinates 86-96
MGDLAMSVADIRMENEPDDLASDNVAEIDVSDEEIDADDLERRMWKDRVRLKRIKERQKAGSQGAQTKETPKKISDQAQRKKMSRAQDGILKYMLKLMEVCKVRGFVYGIIPEKGKPVSGSSDNIRAWWKEKVKFDKNGPAAIAKYEEECLAFGKSDGNRNSQFVLQDLQDATLGSLLSSLMQHCDPPQRKYPLEKGTPPPWWPTGNEEWWVKLGLPKSQSPPYRKPHDLKKMWKVGVLTAVINHMLPDIAKIKRHVRQSKCLQDKMTAKESAIWLAVLNQEESLIQQPSSDNGNSNVTETHRRGNNADRRKPVVNSDSDYDVDGTEEASGSVSSKDSRRNQIQKEQPTAISHSVRDQDKAEKHRRRKRPRIRSGTVNRQEEEQPEAQQRNILPDMNHVDAPLLEYNINGTHQEDDVVDPNIALGPEDNGLELVVPEFNNNYTYLPLVNEQTMMPVDERPMLYGPNPNQELQFGSGYNFYNPSAVFVHNQEDDILHTQIEMNTQAPPHNSGFEEAPGGVLQPLGLLGNEDGVTGSELPQYQSGILSPLTDLDFDYGGFGDDFSWFGA

SEQ ID NO: 2625 - DNA, 1077 bp, Arabidopsis thaliana
  G957,family:NAC
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 2626 - protein, 358 aa, Arabidopsis thaliana
  G957,NAC domain coordinates 12-182
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 2627 - DNA, 1652 bp, Arabidopsis thaliana
  G960,family:NAC
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 2628 - protein, 491 aa, Arabidopsis thaliana
  G960,NAC domain coordinates 13-156
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 2629 - DNA, 1221 bp, Arabidopsis thaliana
  G964,family:HB
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 2630 - protein, 283 aa, Arabidopsis thaliana
  G964,HB domain coordinates 126-186
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 2631 - DNA, 1022 bp, Arabidopsis thaliana
  G986,family:WRKY
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 2632 - protein, 271 aa, Arabidopsis thaliana
  G986,WRKY domain coordinates 146-203
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 2633 - DNA, 3832 bp, Arabidopsis thaliana
  G990,family:ARF
gtaaaatttagcagagagaagaatgaaacaaataattatagcaccgtcacgtcgccgccgtatttcgttaccggaaaaaaaaaaatcattcttcaacataaaaataaaaacagtctctttctttctatctttgtctatctttgattattctctgtgtacccatgttctgcaacagttgagcaagtgcatgccccatatctctctgtttctcatttcccgatctttgcattaatcatatacttcgcctgagatctcgattaagccagcttatagaagaagaaacggcaccagcttctgtcgttttagttagctcgagatctgtgtttctttttttcttggcttctgagcttttggcggtggtgggtttttctggagaaacccaaacgactatcaaagttttgttttttacaattttaagtgggagttatgagtggggtggattaagtaagttacaagtatgaaggagttgaagattcgaagaagcggttttgaagtcggcgagaccaagattgcgagcttatttggctgatgatttatttcagggaagaagaaataaatctgttttttttagggtttttagatttggttggtgaatgggtgggaggtggagggaaacagttaaaaaagttatgcttttagtgtctcttcttcataattacatttgggcatcttgaaatctttggatctttgaagaaacaaagttgtgttttttttttgttctttgttgtttgctttttaagttagaataaaaaatgagattatcttcagctgggtttaatcctcaacctcatgaaggagagaaaagagttcttaattctgagctctggcatgcttgtgctggtcctcttgtctcactacctcctgttggaagcagagttgtgtattttcctcaaggtcacagtgaacaggttgctgcttcgaccaacaaagaagtagatgctcatataccaaattatccgagcttgcatccgcagcttatctgtcagcttcataatgttacaatgcatgctgatgtggagactgatgaagtctatgcacagatgactttgcaaccgttgaatgcgcaagagcaaaaagatccttaccttcccgcggaattaggtgtcccaagtagacagcctacaaactatttctgtaaaactctgactgctagtgatacaagcactcacggaggtttttctgtacctcgccgagctgctgagaaagttttccctcccttggattactcgcagcagccaccagctcaagagttaatggcgagggatctgcatgataatgaatggaagttcaggcatattttccgaggccaaccaaagagacatctccttaccacgggttggagcgtatttgtgagtgctaaaaggcttgttgctggtgactctgttcttttcatctggaacgataagaatcaattacttcttggtataagacgagccaaccgaccacaaactgtcatgccttcatctgttttgtcaagtgacagtatgcatttaggccttcttgctgcagcagctcatgctgccgctacaaacagccgattcaccatcttctataacccgagggcgagtccatcagagtttgttatacccctggctaagtatgtgaaagcggtttatcacactcgcgtctctgttggtatgcggtttaggatgctgtttgaaactgaagaatctagtgttcgtcggtacatgggtacaataactggcatttgtgatctagatcctactcgttgggctaattcgcattggcgatctgtcaaggttgggtgggacgaatctactgcaggagagagacagccaagggtttcattgtgggagattgagcctttaacaacattccctatgtatccatctccttttcctctcaggcttaaacggccgtggcctcctggtctcccatctttccatggccttaaagaagatgatatgggtatgagtatgagttcaccgcttatgtgggatcgaggactccaatctctaaactttcaaggtatgggagtaaacccgtggatgcagccgagacttgatacgtcgggcttgcttggtatgcaaaatgatgtgtaccaagcaatggctgcagctgcccttcaagacatgagaggcattgatcctgcaaaagctgctgcttcacttcttcagttccaaaattcgccggggttctcaatgcaatctccgtccttagtgcagccgcagatgctgcagcagcaactctctcagcagcagcaacaactctctcagcagcagcagcagcagcaacagctctcccaacagcagcagcaacagctctctcaacagcagcagcagcagctctctcaacagcagcagcaacaactctctcagcagcagcagcaacaggcgtatcttggcgttcctgaaacccaccagcctcagtctcaggctcaatcacagtcaaacaatcatctttctcagcagcagcagcaagtagtggataatcataatccgtctgcgtccagtgctgctgttgtttccgctatgtctcaatttggttctgcttctcagcccaacacgtcaccactccagtccatgacctctctgtgtcatcagcaaagcttctccgataccaacggaggaaacaatcctatttctccacttcacactcttctcagtaacttctctcaagacgaatcttctcaactgctccacctcactagaacaaactctgcaatgacttcatccggttggccatcaaagcgtcctgcagttgattcatcgttccagcactctggagccggtaataataacactcaatccgtattggagcaactgggacagtcccacacaagcaacgttcctccaaacgctgtctcgttgcctccatttcccggtggtagagagtgctcgatcgagcaagaaggaagcgcctcagacccgcatagccatcttctctttggagtcaatatagattcatcttctcttttgatgccgaacggaatgtcaaaccttagaagcattggtattgaaggtggtgactccacgactttacccttcacatcatctaatttcaacaatgatttctcgggtaatcttgcaatgacaacaccttctagttgcatagatgaatcgggttttctacaatcctcagaaaacctcggttccgagaacccacaatctaacacctttgtgaaggtgtacaagtcagggtcttttggaagatcgttagatatatcaaagtttagcagctaccacgagctgcgaagcgagcttgctcgcatgtttggcctcgaaggccaattagaagaccctgtgagatcaggctggcagcttgtatttgttgaccgagagaacgacgttcttctcctcggcgatgacccttggccggagtttgtgagcagcgtgtggtgcattaagatactgtcaccacaagaagtgcaacaaatgggaaaaagaggccttgagcttctcaactccgcgccatcttccaacaatgtcgataagctcccgagcaacgggaactgtgacgactttgggaaccggtcagacccgaggaatctcggtaacggtatcgcatcagttgggggttcattcaactactagaagtagatggaaacctccctttttattcaagttaagtttcaatcttataaattagtagtgagatcatcttagtttaattactagcaaaaatctctctttattacttataaaaaagggagatttgcctttgcctttgatggaaacaaaaactatataatccctctgtcgactcgtaatactgtaattataagatcttttggtctttttcttatatgaatatttttactgaactctatatatgtcactttccttaaaaaaaaaaaaaaaaaaaaaaaaaa

SEQ ID NO: 2634 - protein, 933 aa, Arabidopsis thaliana
  G990,ARF domain coordinates NA
MRLSSAGFNPQPHEGEKRVLNSELWHACAGPLVSLPPVGSRVVYFPQGHSEQVAASTNKEVDAHIPNYPSLHPQLICQLHNVTMHADVETDEVYAQMTLQPLNAQEQKDPYLPAELGVPSRQPTNYFCKTLTASDTSTHGGFSVPRRAAEKVFPPLDYSQQPPAQELMARDLHDNEWKFRHIFRGQPKRHLLTTGWSVFVSAKRLVAGDSVLFIWNDKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGICDLDPTRWANSHWRSVKVGWDESTAGERQPRVSLWEIEPLTTFPMYPSPFPLRLKRPWPPGLPSFHGLKEDDMGMSMSSPLMWDRGLQSLNFQGMGVNPWMQPRLDTSGLLGMQNDVYQAMAAAALQDMRGIDPAKAAASLLQFQNSPGFSMQSPSLVQPQMLQQQLSQQQQQLSQQQQQQQQLSQQQQQQLSQQQQQQLSQQQQQQLSQQQQQQAYLGVPETHQPQSQAQSQSNNHLSQQQQQVVDNHNPSASSAAVVSAMSQFGSASQPNTSPLQSMTSLCHQQSFSDTNGGNNPISPLHTLLSNFSQDESSQLLHLTRTNSAMTSSGWPSKRPAVDSSFQHSGAGNNNTQSVLEQLGQSHTSNVPPNAVSLPPFPGGRECSIEQEGSASDPHSHLLFGVNIDSSSLLMPNGMSNLRSIGIEGGDSTTLPFTSSNFNNDFSGNLAMTTPSSCIDESGFLQSSENLGSENPQSNTFVKVYKSGSFGRSLDISKFSSYHELRSELARMFGLEGQLEDPVRSGWQLVFVDRENDVLLLGDDPWPEFVSSVWCIKILSPQEVQQMGKRGLELLNSAPSSNNVDKLPSNGNCDDFGNRSDPRNLGNGIASVGGSFNY

SEQ ID NO: 2635 - protein, 69 aa, Arabidopsis thaliana
  G1004,AP2 domain
KKHYRGVRQRPWGKFAAEIRDPNKRGSRVWLGTFDTAIEAARAYDEAAFRLRGSKAILNFPLEVGKWKP

SEQ ID NO: 2636 - protein, 65 aa, Arabidopsis thaliana
  G1006,AP2 domain
KAKHYRGVRQRPWGKFAAEIRDPAKNGARVWLGTFETAEDAALAYDIAAFRMRGSRALLNFPLRV

SEQ ID NO: 2637 - protein, 68 aa, Arabidopsis thaliana
  G1007,AP2 domain
KGVYRGARMRSWGKWVSEIREPRKKSRIWLGTFPTAEMAARAHDVAALSIKGSSAILNFPELADFLPR

SEQ ID NO: 2638 - protein, 68 aa, Arabidopsis thaliana
  G1008,AP2 domain
VVKYRGVRQRPWGKFAAEIRDPSSRTRLWLGTFATAEEAAIGYDRAAIRIKGHNAQTNFLTPPPSPTT

SEQ ID NO: 2639 - protein, 83 aa, Arabidopsis thaliana
  G1014,ABI3/VP-1 domain
LFQKELKNSDVSSLRRMILPKKAAEAHLPALECKEGIPIRMEDLDGFHVWTFKYRYWPNNNSRMYVLENTGDFVNAHGLQLGD

SEQ ID NO: 2640 - protein, 90 aa, Arabidopsis thaliana
  G1018,ABI3/VP-1 domain
AMTKSSIGNLYRLVLKASFVDIHILRYLPLDDQMMVKEDSGLAVEVYDHDTDSVHNLALKKWAKSSSFVLVSGWRKCFVDRRGLQVGDVI

SEQ ID NO: 2641 - protein, 60 aa, Arabidopsis thaliana
  G1022,WRKY domain
SDEFSWRKYGQKPIKGSPHPRGYYKCSSVRGCPARKHVERALDDAMMLIVTYEGDHNHAL

SEQ ID NO: 2642 - protein, 73 aa, Arabidopsis thaliana
  G1033,HMG domain
DPNKPKRAPSAFFVFLEDFRVTFKKENPNVKAVSAVGKAGGQKWKSMSQAEKAPYEEKAAKRKAEYEKQMDAY

SEQ ID NO: 2643 - protein, 53 aa, Arabidopsis thaliana
  G1048,bZIP domain
DAVAKKRRRRVRNRDAAVRSRERKKEYVQDLEKKSKYLERECLRLGRMLECFV

SEQ ID NO: 2644 - protein, 47 aa, Arabidopsis thaliana
  G1053,bZIP domain
RKQRRMLSNRESARRSRMRKQRHLDELWSQVIRLRNENNCLIDKLNR

SEQ ID NO: 2645 - protein, 61 aa, Arabidopsis thaliana
  G1057,bZIP domain
ELKRQRRKQSNRESARRSRLRKQAECDELAQRAEVLNEENTNLRAEINKLKSQCEELTTEN

SEQ ID NO: 2646 - protein, 58 aa, Arabidopsis thaliana
  G1062,HLH/MYC domain
KKKGMPAKNLMAERRRRKKLNDRLYMLRSVVPKISKMDRASILGDAIDYLKELLQRIN

SEQ ID NO: 2647 - protein, 110 aa, Arabidopsis thaliana
  G1065,DBP domain
EKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCG

SEQ ID NO: 2648 - protein, 9 aa, Arabidopsis thaliana
  G1067,1st AT-hook domain
KRPRGRPPG

SEQ ID NO: 2649 - protein, 152 aa, Arabidopsis thaliana
  G1067,2nd AT-hook domain
SKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEE

SEQ ID NO: 2650 - protein, 9 aa, Arabidopsis thaliana
  G1072,1st AT-hook domain
KKRRGRPRK

SEQ ID NO: 2651 - protein, 116 aa, Arabidopsis thaliana
  G1072,2nd AT-hook domain
FTPHVITVNTGEDITMRIISFSQQGPRAICILSANGVISNVTLRQPDSCGGTLTYEGRFEILSLSGSFMETENQGSKGRSGGMSVSLAGPDGRVVGGGVAGLLIAATPIQVVVGSF

SEQ ID NO: 2652 - protein, 9 aa, Arabidopsis thaliana
  G1076,1st AT-hook domain
RRPRGRPPG

SEQ ID NO: 2653 - protein, 143 aa, Arabidopsis thaliana
  G1076,2nd AT-hook domain
SKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEE

SEQ ID NO: 2654 - protein, 53 aa, Arabidopsis thaliana
  G1078,1st BZIPT2 domain
MGCAASKLDNEDAVRRCKDRRRLMKEAVYARHHLAAAHADYCRSLRITGSALS

SEQ ID NO: 2655 - protein, 111 aa, Arabidopsis thaliana
  G1078,2nd BZIPT2 domain
LCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQN

SEQ ID NO: 2656 - protein, 50 aa, Arabidopsis thaliana
  G1080,BZIPT2 domain
MGASTSRIDEDKALQLCRERKKFVQQALDGRCLLAAAHVSYVQSLKSTGT

SEQ ID NO: 2657 - protein, 53 aa, Arabidopsis thaliana
  G1084,1st BZIPT2 domain
MGCSHSKLDDEEAVQICKDRKRFIKQAIEHRTKFASGHIAYIHSLRKVSDALH

SEQ ID NO: 2658 - protein, 130 aa, Arabidopsis thaliana
  G1084,2nd BZIPT2 domain
SHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQ

SEQ ID NO: 2659 - protein, 76 aa, Arabidopsis thaliana
  G1089,BZIPT2 domain
LEENETHATVLDKLLAWEKKLYDEVKAGELMKIEYQKKVAHLNRVKKRGGHSDSLERAKAAVSHLHTRYIVDMQSM

SEQ ID NO: 2660 - protein, 68 aa, Arabidopsis thaliana
  G1090,AP2 domain
QLSYRGIRRRKWGKWVSEIREPGKKTRIWLGSYETAEMAAAAYDAAALHLRGRGTNLNFPELVDSFPR

SEQ ID NO: 2661 - protein, 58 aa, Arabidopsis thaliana
  G1091,WRKY domain
PDEYSWRKYGQKPIKGSPHPRGYYKCSSVRGCPARKHVERCIDETSMLIVTYEGEHNH

SEQ ID NO: 2662 - protein, 20 aa, Arabidopsis thaliana
  G1098,1st RING/C3H2C3 domain
CHRCQRAVRLHGQEPVCFYC

SEQ ID NO: 2663 - protein, 41 aa, Arabidopsis thaliana
  G1098,2nd RING/C3H2C3 domain
CPVCKDEFELGSEAKQMPCNHIYHSDCIVPWLVQHNSCPVC

SEQ ID NO: 2664 - protein, 8 aa, Arabidopsis thaliana
  G1098,3rd RING/C3H2C3 domain
SSSSSSSS

SEQ ID NO: 2665 - protein, 5 aa, Arabidopsis thaliana
  G1098,4th RING/C3H2C3 domain
SSSSS

SEQ ID NO: 2666 - protein, 44 aa, Arabidopsis thaliana
  G1113,RING/C3H2C3 domain
CTVCLSDFVSDDKIRQLPKCGHVFHHRCLDRWIVDCNKITCPIC

SEQ ID NO: 2667 - protein, 9 aa, Arabidopsis thaliana
  G1127,1st AT-hook domain
KKKRGRPRK

SEQ ID NO: 2668 - protein, 8 aa, Arabidopsis thaliana
  G1127,2nd AT-hook domain
KRNRGRPP

SEQ ID NO: 2669 - protein, 116 aa, Arabidopsis thaliana
  G1127,3rd AT-hook domain
FTPHVIEVNTGEDIASKVMAFSDQGSRTICILSASGAVSRVMLRQASHSSGIVTYEGRFEIITLSGSVLNYEVNGSTNRSGNLSVALAGPDGGIVGGSVVGNLVAATQVQVIVGSF

SEQ ID NO: 2670 - protein, 58 aa, Arabidopsis thaliana
  G1131,HLH/MYC domain
SKKPTLSSQSIAARGRRRRIAEKTHELGKLIPGGNKLNTAEMFQAAAKYVKFLQSQVG

SEQ ID NO: 2671 - protein, 58 aa, Arabidopsis thaliana
  G1133,HLH/MYC domain
SSKQETGSGLSDEQSRKDKIHTALRILESVVPGAKGKEALLLLDEAIDYLKLLKQSLN

SEQ ID NO: 2672 - protein, 59 aa, Arabidopsis thaliana
  G1134,HLH/MYC domain
KRGCATHPRSIAERVRRTRISDRIRKLQELVPNMDKQTNTADMLEEAVEYVKVLQRQIQ

SEQ ID NO: 2673 - protein, 58 aa, Arabidopsis thaliana
  G1136,HLH/MYC domain
NGREEPLNHVEAERQRREKLNQRFYSLRAVVPNVSKMDKASLLGDAISYINELKSKLQ

SEQ ID NO: 2674 - protein, 58 aa, Arabidopsis thaliana
  G1137,HLH/MYC domain
STKEDTGSGLSNEQSKKDKIRTALKILESVVPGAKGNEALLLLDEAIDYLKLLKRDLI

SEQ ID NO: 2675 - protein, 56 aa, Arabidopsis thaliana
  G1140,MADS domain
AREKIRIKKIDNITARQVTFSKRRRGIFKKADELSVLCDADVALIIFSATGKLFEF

SEQ ID NO: 2676 - protein, 68 aa, Arabidopsis thaliana
  G1141,AP2 domain
HCSFRGVRQRIWGKWVAEIREPKIGTRLWLGTFPTAEKAASAYDEAATAMYGSLARLNFPQSVGSEFT

SEQ ID NO: 2677 - protein, 11 aa, Arabidopsis thaliana
  G1146,PAZ domain
GTSRPAHYHVL

SEQ ID NO: 2678 - protein, 38 aa, Arabidopsis thaliana
  G1148,PAZ domain
DTKIVHPTNYDFYMCAHAGKIGTSRPAHYHVLLDEIGF

SEQ ID NO: 2679 - protein, 21 aa, Arabidopsis thaliana
  G1150,PAZ domain
GVKGTSRPTHYHILWDENEFT

SEQ ID NO: 2680 - protein, 51 aa, Arabidopsis thaliana
  G1198,bZIP domain
KQLDAKTLRRLAQNREAARKSRLRKKAYVQQLESSRIKLSQLEQELQRARS

SEQ ID NO: 2681 - protein, 57 aa, Arabidopsis thaliana
  G1211,MISC domain
EYSQTNKLAGRLENVVGWYHSHPGYGCWLSGIDVSTQTLNQQHQEPFLAVVIDPTRT

SEQ ID NO: 2682 - protein, 81 aa, Arabidopsis thaliana
  G1216,1st BPF-1 domain
VKLRIKSFRVPELFIEIPETATVGSLKRMVMEAVSTLLSDGHRVGLMVQGKKVRDDNKTLHQTGISQDNSHLDSLDFSLEP

SEQ ID NO: 2683 - protein, 87 aa, Arabidopsis thaliana
  G1216,2nd BPF-1 domain
QRRIRRPFSVAEVEALVQAVEKLGTGRWRDVKLCAFEDADHRTYVDLKDKWKTLVHTAKISPQQRRGEPVPQELLNRVLNAHGYWTQ

SEQ ID NO: 2684 - protein, 60 aa, Arabidopsis thaliana
  G1226,HLH/MYC domain
EVENQRMTHIAVERNRRRQMNEHLNSLRSLMPPSFLQRGDQASIVGGAIDFIKELEQLLQ

SEQ ID NO: 2685 - protein, 60 aa, Arabidopsis thaliana
  G1228,HLH/MYC domain
EIENQRINHIAVERNRRRQMNEHINSLRALLPPSYIQRGDQASIVGGAINYVKVLEQIIQ

SEQ ID NO: 2686 - protein, 49 aa, Arabidopsis thaliana
  G1231,Z-C4HC3 domain
QCGACGESYAADEFWICCDLCEMWFHGKCVKITPARAEHIKQYKCPSCS

SEQ ID NO: 2687 - protein, 49 aa, Arabidopsis thaliana
  G1233,Z-C4HC3 domain
LCGSCGGHYTNEEFWICCDVCERWYHGKCVKITPAKAESIKQYKCPPCC

SEQ ID NO: 2688 - protein, 193 aa, Arabidopsis thaliana
  G1243,1st SWI/SNF domain
IQGKMRDYQLAGLNWLIRLYENGINGILADEMGLGKTLQTISLLAYLHEYRGINGPHMVVAPKSTLGNWMNEIRRFCPVLRAVKFLGNPEERRHIREDLLVAGKFDICVTSFEMAIKEKTALRRFSWRYIIIDEAHRIKNENSLLSKTMRLFSTNYRLLITGTPLQNNLHELWALLNFLLPEIFSSAETFDEW

SEQ ID NO: 2689 - protein, 85 aa, Arabidopsis thaliana
  G1243,2nd SWI/SNF domain
DILEDYLMYRGYLYCRIDGNTGGDERDASIEAYNKPGSEKFVFLLSTRAGGLGINLATADVVILYDSDWNPQVDLQAQDRAHRIG

SEQ ID NO: 2690 - protein, 50 aa, Arabidopsis thaliana
  G1243,3rd SWI/SNF domain
GFSTWSRRDFNTFLRACEKYGRNDIKSIASEMEGKTEEEVERYAKVFKER

SEQ ID NO: 2691 - protein, 62 aa, Arabidopsis thaliana
  G1243,4th SWI/SNF domain
KGKLYNEECDRFMICMIHKLGYGNWDELKAAFRTSSVFRFDWFVKSRTSQELARRCDTLIRL

SEQ ID NO: 2692 - protein, 113 aa, Arabidopsis thaliana
  G1246,MYB-(R1)R2R3 domain
KKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPP

SEQ ID NO: 2693 - protein, 124 aa, Arabidopsis thaliana
  G1247,MYB-(R1)R2R3 domain
KSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWN

SEQ ID NO: 2694 - protein, 77 aa, Arabidopsis thaliana
  G1249,CAAT domain
PIGRVKKIMKLDKDINKINSEALHVITYSTELFLHFLAEKSAVVTAEKKRKTVNLDHLRIAVKRHQPTSDFLLDSLP

SEQ ID NO: 2695 - protein, 21 aa, Arabidopsis thaliana
  G1256,1st Z-C2H2 domain
CEVCNKGFQREQNLQLHRRGH

SEQ ID NO: 2696 - protein, 21 aa, Arabidopsis thaliana
  G1256,2nd Z-C2H2 domain
CDKCSKRYAVQSDWKAHSKTC

SEQ ID NO: 2697 - protein, 69 aa, Arabidopsis thaliana
  G1266,AP2 domain
EKSYRGVRRRPWGKFAAEIRDSTRNGIRVWLGTFESAEEAALAYDQAAFSMRGSSAILNFSAERVQESL

SEQ ID NO: 2698 - protein, 38 aa, Arabidopsis thaliana
  G1272,PAZ domain
PENVPPGTIIDNKICHPKNNDFYLCAHAGMIGTTRPTH

SEQ ID NO: 2699 - protein, 56 aa, Arabidopsis thaliana
  G1273,1st WRKY domain
VDGYNWRKYGQKQVKGSECPRSYYKCTHPKCPVKKKVERSVEGQVSEIVYQGEHNH

SEQ ID NO: 2700 - protein, 57 aa, Arabidopsis thaliana
  G1273,2nd WRKY domain
EDGFRWRKYGQKVVGGNAYPRSYYRCTSANCRARKHVERASDDPRAFITTYEGKHNH

SEQ ID NO: 2701 - protein, 57 aa, Arabidopsis thaliana
  G1274,WRKY domain
DDGFKWRKYGKKSVKNNINKRNYYKCSSEGCSVKKRVERDGDDAAYVITTYEGVHNH

SEQ ID NO: 2702 - protein, 57 aa, Arabidopsis thaliana
  G1275,WRKY domain
DDGFKWRKYGKKMVKNSPHPRNYYKCSVDGCPVKKRVERDRDDPSFVITTYEGSHNH

SEQ ID NO: 2703 - protein, 99 aa, Arabidopsis thaliana
  G1278,bZIP domain
VKRARRMLSNRESARRSRRRKQEQMNEFDTQVGQLRAEHSTLINRLSDMNHKYDAAAVDNRILRADIETLRTKVKMAEETVKRVTGVNPLHWSRPNMGI

SEQ ID NO: 2704 - protein, 48 aa, Arabidopsis thaliana
  G1297,1st ENBP domain
CHHCKILTSESDLIFCSKCNKKCYCFDCIKRSYSERTHEEVRAACPFC

SEQ ID NO: 2705 - protein, 316 aa, Arabidopsis thaliana
  G1297,2nd ENBP domain
LPRHNAEFIAALPFFDYTDPKSGILNLATRFPEGSLKPDLGPKTYIAYGFHEELNRGDSVTKLHCDISDAVNVLTHTAKVEIPPVKYQNIKVHQKKYAEAMLQKQQYSGQVKEASELENKSMKEVDESKKDLKDKAANEEQSNNSSRPSGSGEAEKVIISKEDNPTQPAVSTSVESIQEQKLDAPKETDGNTNERSKAVHGGAVWDIFRREDVPKLIQFLKRHEHEFRHFNNEPLESVIHPIHDQTMFLSDSQKKQLKEEFDIEPWTFEQHLGEAVFIPAGCPHQVRNRQSCIKVALDFVAPESVEECLRLTQEFR

SEQ ID NO: 2706 - protein, 49 aa, Arabidopsis thaliana
  G1303,Z-C4HC3 domain
LCGSCGGNYTNDEFWICCDVCERWYHGKCVKITPAKAESIKQYKCPSCC

SEQ ID NO: 2707 - protein, 104 aa, Arabidopsis thaliana
  G1305,MYB-(R1)R2R3 domain
KRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRL

SEQ ID NO: 2708 - protein, 128 aa, Arabidopsis thaliana
  G1308,MYB-(R1)R2R3 domain
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEP

SEQ ID NO: 2709 - protein, 103 aa, Arabidopsis thaliana
  G1309,MYB-(R1)R2R3 domain
RKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKR

SEQ ID NO: 2710 - protein, 104 aa, Arabidopsis thaliana
  G1313,MYB-(R1)R2R3 domain
LKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRR

SEQ ID NO: 2711 - protein, 102 aa, Arabidopsis thaliana
  G1315,MYB-(R1)R2R3 domain
RGPWSPEEDAKLKDYIEKQGTGGNWIALPHKAGLRRCAKSCRLRWLNYLRPNIRHGDFTEEEDNIIYSLFASIGSRWSVIAAHLQGRTDNDIKNYWNTKLKK

SEQ ID NO: 2712 - protein, 101 aa, Arabidopsis thaliana
  G1319,MYB-(R1)R2R3 domain
KGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKK

SEQ ID NO: 2713 - protein, 104 aa, Arabidopsis thaliana
  G1320,MYB-(R1)R2R3 domain
RGHWRPAEDEKLRELVEQFGPHNWNAIAQKLSGRSGKSCRLRWFNQLDPRINRNPFTEEEEERLLAPHRIHGNRWSVIARFFPGRTDNAVKNHWHVIMARRGRE

SEQ ID NO: 2714 - protein, 99 aa, Arabidopsis thaliana
  G1324,MYB-(R1)R2R3 domain
RRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTR

SEQ ID NO: 2715 - protein, 104 aa, Arabidopsis thaliana
  G1326,MYB-(R1)R2R3 domain
QRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKR

SEQ ID NO: 2716 - protein, 20 aa, Arabidopsis thaliana
  G1335,1st Z-CLDSH domain
FGFITPDDGGDDLFVHQSSI

SEQ ID NO: 2717 - protein, 14 aa, Arabidopsis thaliana
  G1335,2nd Z-CLDSH domain
CYKCGEPGHMARDC

SEQ ID NO: 2718 - protein, 19 aa, Arabidopsis thaliana
  G1335,3rd Z-CLDSH domain
CYSCGESGHFARDCTSGGR

SEQ ID NO: 2719 - protein, 34 aa, Arabidopsis thaliana
  G1341,1st BZIPT2 domain
MGCCQSRIDSKEIVSRCKARKRYLKHLVKARQTL

SEQ ID NO: 2720 - protein, 111 aa, Arabidopsis thaliana
  G1341,2nd BZIPT2 domain
SHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQ

SEQ ID NO: 2721 - protein, 34 aa, Arabidopsis thaliana
  G1349,Z-LSDlike domain
EVRCRCGRRMWVQPDARTVQCSTCHTVTQLYSLV

SEQ ID NO: 2722 - protein, 22 aa, Arabidopsis thaliana
  G1352,1st Z-C2H2 domain
CNVCEKAFPSYQALGGHKASHR

SEQ ID NO: 2723 - protein, 22 aa, Arabidopsis thaliana
  G1352,2nd Z-C2H2 domain
CSICHKVFPTGQALGGHKRCHY

SEQ ID NO: 2724 - protein, 151 aa, Arabidopsis thaliana
  G1354,NAC domain
IPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKK

SEQ ID NO: 2725 - protein, 151 aa, Arabidopsis thaliana
  G1355,NAC domain
VPPGFRFHPTDEELVGYYLRKKIASQKIDLDVIRDIDLYRIEPWDLQEQCRIGYEEQNEWYFFSHKDKKYPTGTRTNRATMAGFWKATGRDKAVYDKTKLIGMRKTLVFYKGRAPNGKKSDWIMHEYRLESDENAPPQEEGWVVCRAFKKR

SEQ ID NO: 2726 - protein, 142 aa, Arabidopsis thaliana
  G1361,NAC domain
LPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHL

SEQ ID NO: 2727 - protein, 90 aa, Arabidopsis thaliana
  G1364,CAAT domain
REQDRFLPIANISRIMKRGLPANGKIAKDAKEIVQECVSEFISFVTSEASDKCQREKRKTINGDDLLWAMATLGFEDYMEPLKVYLMRYR

SEQ ID NO: 2728 - protein, 23 aa, Arabidopsis thaliana
  G1367,1st AT-hook domain
SSTPQTIKRGRGRPPKAKPDVVQ

SEQ ID NO: 2729 - protein, 24 aa, Arabidopsis thaliana
  G1367,2nd AT-hook domain
VSGGVETVKRRGRPPSGRAAGRER

SEQ ID NO: 2730 - protein, 22 aa, Arabidopsis thaliana
  G1367,3rd AT-hook domain
PYVANGGVRRRGRPKRVDAGGA

SEQ ID NO: 2731 - protein, 23 aa, Arabidopsis thaliana
  G1367,4th AT-hook domain
GGEEVAVKKRGRGRPPKIGGVIR

SEQ ID NO: 2732 - protein, 57 aa, Arabidopsis thaliana
  G137,MADS domain
MGRGRVELKRIENKINRQVTFAKRRNGLLKKAYELSVLCDAEVALIIFSNRGKLYEF

SEQ ID NO: 2733 - protein, 68 aa, Arabidopsis thaliana
  G1379,AP2 domain
DRPYKGIRMRKWGKWVAEIREPNKRSRLWLGSYSTPEAAARAYDTAVFYLRGPTARLNFPELLPGEKF

SEQ ID NO: 2734 - protein, 57 aa, Arabidopsis thaliana
  G138,MADS domain
MGRGKVELKRIENKINRQVTFAKRRNGLLKKAYELSVLCDAEIALLIFSNRGKLYEF

SEQ ID NO: 2735 - protein, 57 aa, Arabidopsis thaliana
  G1382,1st WRKY domain
ADDGYNWRKYGQKHVKGSEFPRSYYKCTHPNCEVKKLFERSHDGQITDIIYKGTHDH

SEQ ID NO: 2736 - protein, 53 aa, Arabidopsis thaliana
  G1382,2nd WRKY domain
RWRKYGQKVVRGNPNPRSYYKCTAHGCPVRKHVERASHDPKAVITTYEGKHDH

SEQ ID NO: 2737 - protein, 68 aa, Arabidopsis thaliana
  G1384,AP2 domain
AKLYRGVRQRHWGKWVAEIRLPRNRTRLWLGTFDTAEEAALAYDRAAFKLRGDSARLNFPALRYQTGS

SEQ ID NO: 2738 - protein, 58 aa, Arabidopsis thaliana
  G1389,TEO domain
KDRHSKVFTSKGPRDRRVRLSAHTAIQFYDVQDRLGYDRPSKAVDWLIKKAKTAIDKL

SEQ ID NO: 2739 - protein, 57 aa, Arabidopsis thaliana
  G139,MADS domain
MGRGRVELKRIENKINRQVTFAKRRNGLLKKAYELSVLCDAEVSLIVFSNRGKLYEF

SEQ ID NO: 2740 - protein, 51 aa, Arabidopsis thaliana
  G1394,S1FA domain
EAKGLNPGLIVLLVIGGLLVTFLIANYVMYMYAQKNLPPRKKKPLSKKKLK

SEQ ID NO: 2741 - protein, 72 aa, Arabidopsis thaliana
  G1395,S1FA domain
MAAEFDGKIESKGLNPGLIVLLVIGGLLLTFLVGNFILYTYAQKNLPPRKKKPVSKKKMKKEKMKQGVQVPG

SEQ ID NO: 2742 - protein, 57 aa, Arabidopsis thaliana
  G140,MADS domain
IGRGKIEIKRIENTTNRQVTFCKRRNGLLKKAYELSVLCDAEVALVIFSTRGRLYEY

SEQ ID NO: 2743 - protein, 46 aa, Arabidopsis thaliana
  G1403,GF14 domain
EALMMLDALGDELYKDSTLIMKILRDNLTFWTSDMTDEAGDEIKEA

SEQ ID NO: 2744 - protein, 93 aa, Arabidopsis thaliana
  G1410,HS domain
FFCKTLLFVAVAGVLFIRKNEDVDKLKNLFDETTLYDKQWQAAWKNDDDESLGSKKKLLDRYGFRKLDSEQREFADGDFVRGKPELIRNIYKR

SEQ ID NO: 2745 - protein, 69 aa, Arabidopsis thaliana
  G1419,AP2 domain
QRHYRGVRRRPWGKYAAEIRDPNKKGVRVWLGTFDTAMEAARGYDKAAFKLRGSKAILNFPLEAGKHED

SEQ ID NO: 2746 - protein, 63 aa, Arabidopsis thaliana
  G1421,AP2 domain
TRKFRGVRQRPWGKWAAEIRDPSRRVRVWLGTFDTAEEAAIVYDNAAIQLRGPNAELNFPPPP

SEQ ID NO: 2747 - protein, 57 aa, Arabidopsis thaliana
  G1423,MADS domain
GTKRKIAIETIQKRDSLRVTCTKRREGLYSKASQLCLLSDAQIAILATPPSSESNVS

SEQ ID NO: 2748 - protein, 49 aa, Arabidopsis thaliana
  G1435,GARP domain
WTPQLHKRFVDVVAHLGIKNAVPKTIMQLMNVEGLTRENVASHLQKYRL

SEQ ID NO: 2749 - protein, 92 aa, Arabidopsis thaliana
  G1437,GRF-like domain
PFTNAQLKELERQAMIYKYKIASIPVPFDLLVSSPSSASPCNNKNIAGDLEPGRCRRTDGKKWRCAKEVVSNHKYCEKHLHRGRPRSRKHVE

SEQ ID NO: 2750 - protein, 109 aa, Arabidopsis thaliana
  G1438,GRF-like domain
PFTPTQWEELEHQALIYKYMVSGVPVPPELIFSIRRSLDTSLVSRLLPHQSLGWGCYQMGFGRKPDPEPGRCRRTDGKKWRCSREAYPDSKYCEKHMHRGRNRARKSLD

SEQ ID NO: 2751 - protein, 107 aa, Arabidopsis thaliana
  G1439,GRF-like domain
PFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVE

SEQ ID NO: 2752 - protein, 113 aa, Arabidopsis thaliana
  G1442,GRF-like domain
AFSEAQWHELERQRNIYKYMMASVPVPPELLTPFPKNHQSNTNPDVTVAVATGGSLQLGIASSASNNTADLEPWRCKRTDGKKWRCSRNVIPDQKYCERHTHKSRPRSRKHVE

SEQ ID NO: 2753 - protein, 109 aa, Arabidopsis thaliana
  G1443,GRF-like domain
WMKAAQLMEFRMQALVYRYIEAGLRVPHHLVVPIWNSLALSSSSNYNYHSSSLLSNKGVTHIDTLETEPTRCRRTDGKKWRCSNTVLLFEKYCERHMHRGRKRSRKLVE

SEQ ID NO: 2754 - protein, 57 aa, Arabidopsis thaliana; identical to SEQ ID NO: 2732
  G145,MADS domain

SEQ ID NO: 2755 - protein, 336 aa, Arabidopsis thaliana
  G1451,ARF domain
ELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEP

SEQ ID NO: 2756 - protein, 57 aa, Arabidopsis thaliana
  G146,MADS domain
MGRGKIEIKRIENSTNRQVTFCKRRNGLLKKAYELSVLCDAEVALIVFSTRGRLYEY

SEQ ID NO: 2757 - protein, 260 aa, Arabidopsis thaliana
  G1462,NAC domain
ELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKK

SEQ ID NO: 2758 - protein, 21 aa, Arabidopsis thaliana
  G1469,1st Z-C2H2 domain
CQVCKKSFSNGKALGGHMRAH

SEQ ID NO: 2759 - protein, 21 aa, Arabidopsis thaliana
  G1469,2nd Z-C2H2 domain
CDTCGKVLRSYQALGGHRTSH

SEQ ID NO: 2760 - protein, 21 aa, Arabidopsis thaliana
  G1469,3rd Z-C2H2 domain
CQICNRMFASGQALGGHKKIH

SEQ ID NO: 2761 - protein, 22 aa, Arabidopsis thaliana
  G1471,Z-C2H2 domain
CYLCKRAFPTPHALGGHGTTHK

SEQ ID NO: 2762 - protein, 28 aa, Arabidopsis thaliana
  G1474,Z-C2H2 domain
CSFCRREFKSAQALGGHMNVHRRDRARL

SEQ ID NO: 2763 - protein, 45 aa, Arabidopsis thaliana
  G1478,Z-CO-like domain
CELCGENATVYCEADAAFLCRKCDRWVHSANFLARRHLRRVICTT

SEQ ID NO: 2764 - protein, 57 aa, Arabidopsis thaliana
  G148,MADS domain
MGRGKVEVKRIENKITRQVTFSKRKSGLLKKAYELSVLCDAEVSLIIFSTGGKLYEF

SEQ ID NO: 2765 - protein, 24 aa, Arabidopsis thaliana
  G1480,1st Z-CO-like domain
CDSCKSATAALYCRPDAAFLCLSC

SEQ ID NO: 2766 - protein, 25 aa, Arabidopsis thaliana
  G1480,2nd Z-CO-like domain
MCEVCEQAPAHVTCKADAAALCVTC

SEQ ID NO: 2767 - protein, 26 aa, Arabidopsis thaliana
  G1487,GATA/Zn domain
CSHCGVQKTPQWRAGPMGAKTLCNAC

SEQ ID NO: 2768 - protein, 26 aa, Arabidopsis thaliana
  G1488,GATA/Zn domain
CLHCATDKTPQWRTGPMGPKTLCNAC

SEQ ID NO: 2769 - protein, 51 aa, Arabidopsis thaliana
  G1491,GARP domain
WTPDLHERFVEAVNQLGGGDKATPKTIMKVMGIPGLTLYHLKSHLQKYRLS

SEQ ID NO: 2770 - protein, 58 aa, Arabidopsis thaliana
  G1494,HLH/MYC domain
RRSRAAEVHNLSERRRRDRINERMKALQELIPHCSKTDKASILDEAIDYLKSLQLQLQ

SEQ ID NO: 2771 - protein, 58 aa, Arabidopsis thaliana
  G1498,HLH/MYC domain
KRSRAAEVHNLSERKRRDRINERMKALQELIPRCNKSDKASMLDEAIEYMKSLQLQIQ

SEQ ID NO: 2772 - protein, 77 aa, Arabidopsis thaliana
  G15,1st AP2 domain
TSQYRGVTRHRWTGRYEAHLWDNSFKKEGHSRKGRQVYLGGYDMEEKAARAYDLAALKYWGPSTHTNFSAENYQKEI

SEQ ID NO: 2773 - protein, 69 aa, Arabidopsis thaliana
  G15,2nd AP2 domain
ASIYRGVTRHHQHGRWQARIGRVAGNKDLYLGTFGTQEEAAEAYDVAAIKFRGTNAVTNFDITRYDVDR

SEQ ID NO: 2774 - protein, 27 aa, Arabidopsis thaliana
  G1506,GATA/Zn domain
CYHCGVTSTPLWRNGPPEKPVLCNACG

SEQ ID NO: 2775 - protein, 34 aa, Arabidopsis thaliana
  G1510,GATA/Zn domain
RVCSDCNTTKTPLWRSGPRGPKSLCNACGIRQRK

SEQ ID NO: 2776 - protein, 38 aa, Arabidopsis thaliana
  G1517,RING/C3HC4 domain
CFICREPFLDPVVTKCKHYFCEHCALKHHTKNKKCFVC

SEQ ID NO: 2777 - protein, 43 aa, Arabidopsis thaliana
  G1518,1st RING/C3HC4 domain
LCPICMQIIKDAFLTACGHSFCYMCIITHLRNKSDCPCCSQHL

SEQ ID NO: 2778 - protein, 84 aa, Arabidopsis thaliana
  G1518,2nd RING/C3HC4 domain
FREALQRGCDVSIKEVDNLLTLLAERKRKMEQEEAERNMQILLDFLHCLRKQKVDELNEVQTDLQYIKEDINAVERHRIDLYRA

SEQ ID NO: 2779 - protein, 297 aa, Arabidopsis thaliana
  G1518,3rd RING/C3HC4 domain
VSSIEFDRDDELFATAGVSRCIKVFDFSSVVNEPADMQCPIVEMSTRSKLSCLSWNKHEKNHIASSDYEGIVTVWDVTTRQSLMEYEEHEKRAWSVDFSRTEPSMLVSGSDDCKVKVWCTRQEASVINIDMKANICCVKYNPGSSNYIAVGSADHHIHYYDLRNISQPLHVFSGHKKAVSYVKFLSNNELASASTDSTLRLWDVKDNLPVRTFRGHTNEKNFVGLTVNSEYLACGSETNEVYVYHKEITRPVTSHRFGSPDMDDAEEEAGSYFISAVCWKSDSPTMLTANSQGTIKV

SEQ ID NO: 2780 - protein, 42 aa, Arabidopsis thaliana
  G1521,RING/C3HC4 domain
CPICLENLTERRSAAVITVCKHGYCLACIRKWSSFKRNCPLC

SEQ ID NO: 2781 - protein, 38 aa, Arabidopsis thaliana
  G1527,RING/C3HC4 domain
CGICMEMNSKVVLPNCTHSLCIKCYRDWRGRSQSCPFC

SEQ ID NO: 2782 - protein, 43 aa, Arabidopsis thaliana
  G1530,RING/C3H2C3 domain
CIICLSEFQDGDTLRVLERCKHGFHVYCIQKWLSSSHSSCPTC

SEQ ID NO: 2783 - protein, 37 aa, Arabidopsis thaliana
  G1531,RING/C3HC4 domain
HPYMCDTSVRHSNCFKQFRRKTIKKRLYPKTLHCPLC

SEQ ID NO: 2784 - protein, 61 aa, Arabidopsis thaliana
  G1535,HB domain
PAKKKRYHRHTNRQIQEMEALFKENPHPDDKQRKRLSAELGLKPRQVKFWFQNRRTQMKAQ

SEQ ID NO: 2785 - protein, 61 aa, Arabidopsis thaliana
  G1538,HB domain
IGGMLRKRKLTDEQVNMLEYSFGNEHKLESGRKEKIAGELGLDPRQVAVWFQNRRARWKNK

SEQ ID NO: 2786 - protein, 56 aa, Arabidopsis thaliana
  G154,MADS domain
VRGKTQMKRIENATSRQVTFSKRRNGLLKKAFELSVLCDAEVSLIIFSPKGKLYEF

SEQ ID NO: 2787 - protein, 64 aa, Arabidopsis thaliana
  G1540,HB domain
STRWTPTTEQIKILKELYYNNAIRSPTADQIQKITARLRQFGKIEGKNVFYWFQNHKARERQKK

SEQ ID NO: 2788 - protein, 61 aa, Arabidopsis thaliana
  G1543,HB domain
APPRKKLRLTREQSRLLEDSFRQNHTLNPKQKEVLAKHLMLRPRQIEVWFQNRRARSKLKQ

SEQ ID NO: 2789 - protein, 61 aa, Arabidopsis thaliana
  G1549,HB domain
MTSEQLKFLERSFQEEIKLNPDRKMKLNPDRKMKLSKELGLQPRQIAVWFQNRKARWKNKQ

SEQ ID NO: 2790 - protein, 62 aa, Arabidopsis thaliana
  G1551,HB domain
RWTPTPVQLQILERIFDQGTGTPSKQKIKDITEELSQHGQIAEQNVYNWFQNRRARSKRKQH

SEQ ID NO: 2791 - protein, 332 aa, Arabidopsis thaliana
  G1553,ARF domain
TELWKACAGPLVEVPRYGERVFYFPQGHMEQLVASTNQGVVDQEIPVFNLPPKILCRVLSVTLKAEHETDEVYAQITLQPEEDQSEPTSLDPPLVEPAKPTVDSFVKILTASDTSTHGGFSVLRKHATECLPSLDMTQPTPTQELVARDLHGYEWRFKHIFRGQPRRHLLTTGWSTFVTSKRLVAGDAFVFLRGETGDLRVGVRRLAKQQSTMPASVISSQSMRLGVLATASHAVTTTTIFVVFYKPRISQFIISVNKYMMAMKNGFSLGMRYRMRFEGEESPERIFTGTIIGSGDLSSQWPASKWRSLQIQWDEPSSIQRPNKVSPWEIEP

SEQ ID NO: 2792 - protein, 100 aa, Arabidopsis thaliana
  G1559,TH domain
WAQDETRTLISLRREMDNLFNTSKSNKHLWEQISKKMREKGFDRSPSMCTDKWRNILKEFKKAKQHEDKATSGGSTKMSYYNEIEDIFRERKKKVAFYKS

SEQ ID NO: 2793 - protein, 56 aa, Arabidopsis thaliana
  G156,MADS domain
GRGKIEIKKIENQTARQVTFSKRRTGLIKKTRELSILCDAHIGLIVFSATGKLSEF

SEQ ID NO: 2794 - protein, 56 aa, Arabidopsis thaliana
  G157,MADS domain
GRRKIEIKRIENKSSRQVTFSKRRNGLIDKARQLSILCESSVAVVVVSASGKLYDS

SEQ ID NO: 2795 - protein, 55 aa, Arabidopsis thaliana
  G159,MADS domain
GRRKIELVKMTNESNLQVTFSKRRSGLFKKGSELCTLCDAEIAIIVFSPSGKAYS

SEQ ID NO: 2796 - protein, 51 aa, Arabidopsis thaliana
  G1634,1st MYB-related domain
SSWTKEENKKFERALAVYADDTPDRWFKVAAMIPGKTISDVMRQYSKLEED

SEQ ID NO: 2797 - protein, 49 aa, Arabidopsis thaliana
  G1634,2nd MYB-related domain
VPWTEEEHRRFLLGLLKYGKGDWRNISRNFVGSKTPTQVASHAQKYYQR

SEQ ID NO: 2798 - protein, 47 aa, Arabidopsis thaliana
  G1635,MYB-related domain
ERWTDEEHKKFVEALKLYGRAWRRIEEHVGSKTAVQIRSHAQKFFSK

SEQ ID NO: 2799 - protein, 49 aa, Arabidopsis thaliana
  G1637,MYB-related domain
KPWTEEEHRNFLIGLNKLGKGDWRGIAKSFVSTRTPTQVASHAQKYFIR

SEQ ID NO: 2800 - protein, 51 aa, Arabidopsis thaliana
  G1638,1st MYB-related domain
TKWTAEENKKFENALAFYDKDTPDRWSRVAAMLPGKTVGDVIKQYRELEED

SEQ ID NO: 2801 - protein, 49 aa, Arabidopsis thaliana
  G1638,2nd MYB-related domain
VPWTEEEHRQFLMGLKKYGKGDWRNIARNFVTTRTPTQVASHAQKYFIR

SEQ ID NO: 2802 - protein, 102 aa, Arabidopsis thaliana
  G1640,MYB-(R1)R2R3 domain
RGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRK

SEQ ID NO: 2803 - protein, 97 aa, Arabidopsis thaliana
  G1646,CAAT domain
QEIEQVNDFKNHQLPLARIKKIMKADEDVRMISAEAPILFAKACELFILELTIRSWLHAEENKRRTLQKNDIAAAITRTDIFDFLVDIVPREEIKEE

SEQ ID NO: 2804 - protein, 56 aa, Arabidopsis thaliana
  G165,MADS domain
GRRKVEIVKMTKESNLQVTFSKRKAGLFKKASEFCTLCDAKIAMIVFSPAGKVFSF

SEQ ID NO: 2805 - protein, 58 aa, Arabidopsis thaliana
  G1656,HLH/MYC domain
RSPVLAKEHVLAERKRREKLSEKFIALSALLPGLKKADKVTILDDAISRMKQLQEQLR

SEQ ID NO: 2806 - protein, 42 aa, Arabidopsis thaliana
  G1657,1st DBP domain
PRPKTPREPMEFLCRSWSLSTSEISLALSSQKSDKQLNKNPN

SEQ ID NO: 2807 - protein, 120 aa, Arabidopsis thaliana
  G1657,2nd DBP domain
AVKKRDRVRVEKAHLHSAVSIASLATAIAAVTASGNQDGFAGSKMSSALASASELLASHCLELAELAGADHDRVVSAVRSAVDVRGPGDLLTLTAAAATALRGEAALRVRLPKEAKNSAA

SEQ ID NO: 2808 - protein, 100 aa, Arabidopsis thaliana
  G1659,DBP domain
IKAWKELKITKVNNKTQKKLLDISGWEKKKTTKIESELARIQRKMDSKKMEKSEKLRNEKAAVHAKAQKKKADVQTRRAQEILDAEEAAARFQAAGKIPK

SEQ ID NO: 2809 - protein, 55 aa, Arabidopsis thaliana
  G166,MADS domain
KRKMKLSLIENSVSRKTTFTKRKKGMTKKLTELVTLCGVEACAVVYSPFNSIPEA

SEQ ID NO: 2810 - protein, 115 aa, Arabidopsis thaliana
  G1660,DBP domain
TKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPS

SEQ ID NO: 2811 - protein, 58 aa, Arabidopsis thaliana
  G1666,HLH/MYC domain
RLPREDLSHVVAERRRREKLNEKFITLRSMVPFVTKMDKVSILGDTIAYVNHLRKRVH

SEQ ID NO: 2812 - protein, 56 aa, Arabidopsis thaliana
  G167,MADS domain
GRKKLKLKRIESLKERSSKFSKRKKGLFKKAEEVALLCDSDIMLIVVSPTEKPTVF

SEQ ID NO: 2813 - protein, 184 aa, Arabidopsis thaliana
  G1670,NAC domain
LPIGYRFHPTEQELILHYLLPKAFASPLPSSIIPVFDLFFSHPLSFPGLFLSLSLSLCSFCQSLYVCICLLVFLNCFLFKMVYLMFGSRSGVSDAKTEEVLLSGDQKEKQRYFFCKKREVSSNEHRIKISSGDGYWKPIGKERPIIACGKTFGIRRTLAFYETNKSSSYCNKTRWSMTEYCLAG

SEQ ID NO: 2814 - protein, 57 aa, Arabidopsis thaliana
  G168,MADS domain
MGMKKVKLSLIANEISRETSFMKRKNGIMKKLYELSTLCGVQACTLIYSPFIPVPEF

SEQ ID NO: 2815 - protein, 42 aa, Arabidopsis thaliana
  G1730,RING/C3H2C3 domain
CAICLSEFSDEDTVRLITVCRHPFHSNCIDLWFELHKTCPVC

SEQ ID NO: 2816 - protein, 41 aa, Arabidopsis thaliana
  G1736,RING/C3H2C3 domain
CPICFEDYDVENPRLTTKCEHEFHLSCLLEWIERSDRCPIC

SEQ ID NO: 2817 - protein, 63 aa, Arabidopsis thaliana
  G1750,AP2 domain
QKKYRGVRQRPWGKWAAEIRDPEQRRRIWLGTFATAEEAAIVYDNAAIKLRGPDALTNFTVQP

SEQ ID NO: 2818 - protein, 68 aa, Arabidopsis thaliana
  G1751,AP2 domain
KNGYRGVRQRPWGKFAAEIRDPKRATRVWLGTFETAEDAARAYDRAAIGFRGPRAKLNFPFVDYTSSV

SEQ ID NO: 2819 - protein, 69 aa, Arabidopsis thaliana
  G1752,AP2 domain
ERSYRGVRKRPWGKFAAEIRDSTRNGIRVWLGTFDKAEEAALAYDQAAFATKGSLATLNFPVEVVRESL

SEQ ID NO: 2820 - protein, 63 aa, Arabidopsis thaliana
  G1755,AP2 domain
ICDYTGVRQRTWGKWVAEIREPGRGAKLWLGTFSSSYEAALAYDEASKAIYGQSARLNLPLLP

SEQ ID NO: 2821 - protein, 61 aa, Arabidopsis thaliana
  G1757,WRKY domain
DDVFSWRKYGQKDILGAKFPRSYYRCTHRSTQNCWATKQVQRSDGDATVFEVTYRGTHTCS

SEQ ID NO: 2822 - protein, 57 aa, Arabidopsis thaliana
  G1758,WRKY domain
DDGYKWRKYGKKPITGSPFPRHYHKCSSPDCNVKKKIERDTNNPDYILTTYEGRHNH

SEQ ID NO: 2823 - protein, 56 aa, Arabidopsis thaliana
  G1759,MADS domain
GRKKLEIKRIENKSSRQVTFSKRRNGLIEKARQLSVLCDASVALLVVSASGKLYSF

SEQ ID NO: 2824 - protein, 56 aa, Arabidopsis thaliana
  G1760,MADS domain
GRGKIVIQRIDDSTSRQVTFSKRRKGLIKKAKELAILCDAEVGLIIFSSTGKLYDF

SEQ ID NO: 2825 - protein, 68 aa, Arabidopsis thaliana; identical to SEQ ID NO: 2737
  G1763,AP2 domain

SEQ ID NO: 2826 - protein, 121 aa, Arabidopsis thaliana
  G1765,NAC domain
PGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHE

SEQ ID NO: 2827 - protein, 66 aa, Arabidopsis thaliana
  G1767,1st SCR domain
VLKFQEVSPWATFGHVAANGAILEAVDGEAKIHIVDISSTFCTQWPTLLEALATRSDDTPHLRLTT

SEQ ID NO: 2828 - protein, 96 aa, Arabidopsis thaliana
  G1767,2nd SCR domain
INCVGAMHGIASRGSPRDAVISSFRRLRPRIVTVVEEEADLVGEEEGGFDDEFLRGFGECLRWFRVCFESWEESFPRTSNERLMLERAAGRAIVDL

SEQ ID NO: 2829 - protein, 76 aa, Arabidopsis thaliana
  G1767,3rd SCR domain
CEPSDSTERRETARKWSRRMRNSGFGAVGYSDEVADDVRALLRRYKEGVWSMVQCPDAAGIFLCWRDQPVVWASAW

SEQ ID NO: 2830 - protein, 54 aa, Arabidopsis thaliana
  G1772,RING/C3HC4 domain
CDVCMEDLPGDHMTRMDCGHCFCNNCWTEHFTVQINEGQSKRIRCMAHQCNAIC

SEQ ID NO: 2831 - protein, 115 aa, Arabidopsis thaliana
  G1774,RING/C3HC4 domain
CGICFESYTREEIARVSCGHPYCKTCWAGYITTKIEDGPGCLRVKCPEPSCSAAVGKDMIEDVTETKVNEKYSRYILRSYVEDGKKIKWCPSPGCGYAVEFGGSESSSYDVSCLC

SEQ ID NO: 2832 - protein, 121 aa, Arabidopsis thaliana
  G1775,RING/C3HC4 domain
CGICFESYTRKEIASVSCGHPYCKTCWTGYITTKIEDGPGCLRVKCPEPSCYAVVGQDMIDEVTEKKDKDKYYRYFLRSYVEDGKKMKWCPSPGCECAVEFGESSGYDVACLCSYRFCWNC

SEQ ID NO: 2833 - protein, 124 aa, Arabidopsis thaliana
  G1777,RING/C3HC4 domain
CDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSC

SEQ ID NO: 2834 - protein, 90 aa, Arabidopsis thaliana
  G1781,CAAT domain
KEQDRFLPIANVGRIMKKVLPGNGKISKDAKETVQECVSEFISFVTGEASDKCQREKRKTINGDDIIWAITTLGFEDYVAPLKVYLCKYR

SEQ ID NO: 2835 - protein, 51 aa, Arabidopsis thaliana
  G1789,MYB-related domain
GSWTVKQNKAFERALAVYDQDTPDRWHNVARAVGGKTPEEAKRQYDLLVRD

SEQ ID NO: 2836 - protein, 57 aa, Arabidopsis thaliana
  G179,WRKY domain
DDGYRWRKYGQKAVKNNPFPRSYYKCTEEGCRVKKQVQRQWGDEGVVVTTYQGVHTH

SEQ ID NO: 2837 - protein, 57 aa, Arabidopsis thaliana
  G1797,MADS domain
MVRGKIEIKKIENVTSRQVTFSKRRSGLFKKAHELSVLCDAQVAAMIFSQKGRLYEF

SEQ ID NO: 2838 - protein, 68 aa, Arabidopsis thaliana
  G1800,AP2 domain
LCQYRGVRQRTWGKWVAEIREPKKRARLWLGSFATAEEAAMAYDEAALKLYGHDAYLNLPHLQRNTRP

SEQ ID NO: 2839 - protein, 51 aa, Arabidopsis thaliana
  G1804,bZIP domain
RRQRRMIKNRESAARSRARKQAYTVELEAELNQLKEENAQLKHALAELERK

SEQ ID NO: 2840 - protein, 61 aa, Arabidopsis thaliana
  G1806,bZIP domain
RTLRRLAQNREAARKSRLRKKAYVQQLENSRIRLAQLEEELKRARQQGSLVERGVSADHTH

SEQ ID NO: 2841 - protein, 49 aa, Arabidopsis thaliana
  G1807,bZIP domain
DDSKNGNENRDDMESSRASGTKTNGSDTEGESSSVNESANNNMNSSGEK

SEQ ID NO: 2842 - protein, 61 aa, Arabidopsis thaliana
  G1808,bZIP domain
RKRKRMESNRESAKRSRMRKQSHIDNLREQVNRLDLENRELGNRLRLVLHQLQRVNSDNNR

SEQ ID NO: 2843 - protein, 13 aa, Arabidopsis thaliana
  G1809,1st bZIP domain
ESDEELLMVPDME

SEQ ID NO: 2844 - protein, 80 aa, Arabidopsis thaliana
  G1809,2nd bZIP domain
RRRGRNPVDKEYRSLKRLLRNRVSAQQARERKKVYVSDLESRANELQNNNDQLEEKISTLTNENTMLRKMLINTRPKTDD

SEQ ID NO: 2845 - protein, 95 aa, Arabidopsis thaliana
  G1811,ABI3/VP-1 domain
KEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHR

SEQ ID NO: 2846 - protein, 334 aa, Arabidopsis thaliana
  G1812,PCOMB domain
GKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWD

SEQ ID NO: 2847 - protein, 97 aa, Arabidopsis thaliana
  G1819,CAAT domain
QMGNATDVKHHAFPLTRIKKIMKSNPEVNMVTAEAPVLISKACEMLILDLTMRSWLHTVEGGRQTLKRSDTLTRSDISAATTRSFKFTFLGDVVPRD

SEQ ID NO: 2848 - protein, 90 aa, Arabidopsis thaliana
  G1821,CAAT domain
REQDRFMPIANVIRIMRRILPAHAKISDDSKETIQECVSEYISFITGEANERCQREQRKTITAEDVLWAMSKLGFDDYIEPLTLYLHRYR

SEQ ID NO: 2849 - protein, 48 aa, Arabidopsis thaliana
  G1824,GARP domain
WTPELHRRFVEAVEQLGVDKAVPSRILELMGVHCLTRHNVASHLQKYR

SEQ ID NO: 2850 - protein, 87 aa, Arabidopsis thaliana
  G1836,CAAT domain
KEMEGNLDFKNHDLPITRIKKIMKYDPDVTMIASEAPILLSKACEMFIMDLTMRSWLHAQESKRVTLQKSNVDAAVAQTVIFDFLLD

SEQ ID NO: 2851 - protein, 75 aa, Arabidopsis thaliana
  G1838,1st AP2 domain
SIYRGVTRHRWTGRYEAHLWDNSCRREGQARKGRQVYLGGYDKEDRAARAYDLAALKYWGSTATTNFPVSSYSKE

SEQ ID NO: 2852 - protein, 71 aa, Arabidopsis thaliana
  G1838,2nd AP2 domain
GASIYRGVTRHHQQGRWQARIGRVAGNKDLYLGTFATEEEAAEAYDIAAIKFRGINAVTNFEMNRYDIEAV

SEQ ID NO: 2853 - protein, 65 aa, Arabidopsis thaliana
  G1839,AP2 domain
EKKYKGVRKKPSGKWAAEIWDPRSKSRRWLGTFLTAEMAAQSYNDAAAEYRARRGKTNGEGIKRR

SEQ ID NO: 2854 - protein, 56 aa, Arabidopsis thaliana
  G1842,MADS domain
GRRKVEIKRIENKSSRQVTFSKRRKGLIEKARQLSILCESSIAVVAVSGSGKLYDS

SEQ ID NO: 2855 - protein, 56 aa, Arabidopsis thaliana
  G1843,MADS domain
GRRKVEIKRIENKSSRQVTFCKRRNGLMEKARQLSILCESSVALIIISATGRLYSF

SEQ ID NO: 2856 - protein, 56 aa, Arabidopsis thaliana
  G1844,MADS domain
GRRRVEIKRIENKSSRQVTFCKRRNGLMEKARQLSILCGSSVALFIVSSTGKLYNS

SEQ ID NO: 2857 - protein, 60 aa, Arabidopsis thaliana
  G1847,WRKY domain
DDIFSWRKYGQKDILGAKFPRSYYRCTFRNTQYCWATKQVQRSDGDPTIFEVTYRGTHTC

SEQ ID NO: 2858 - protein, 92 aa, Arabidopsis thaliana
  G1850,HS domain
PFLTKTYQLVEDPVYDELISWNEDGTTFIVWRPAEFARDLLPKYFKHNNFSSFVRQLNTYGFRKVVPDRWEFSNDCFKRGEKILLRDIQRRK

SEQ ID NO: 2859 - protein, 512 aa, Arabidopsis thaliana
  G1855,AKR domain
EYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVK

SEQ ID NO: 2860 - protein, 112 aa, Arabidopsis thaliana
  G1863,GRF-like domain
FFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVE

SEQ ID NO: 2861 - protein, 118 aa, Arabidopsis thaliana
  G1865,GRF-like domain
PFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKP

SEQ ID NO: 2862 - protein, 24 aa, Arabidopsis thaliana
  G1881,1st Z-CO-like domain
CDACESAAAIVFCAADEAALCCSC

SEQ ID NO: 2863 - protein, 24 aa, Arabidopsis thaliana
  G1881,2nd Z-CO-like domain
CDICENAPAFFYCEIDGSSLCLQC

SEQ ID NO: 2864 - protein, 29 aa, Arabidopsis thaliana
  G1884,Z-Dof domain
CPRCDSVNTKFCYYNNYSLSQPRHYCKNC

SEQ ID NO: 2865 - protein, 32 aa, Arabidopsis thaliana
  G1888,1st Z-CO-like domain
KIWCAVCDKEEASVFCCADEAALCNGCDRHVH

SEQ ID NO: 2866 - protein, 43 aa, Arabidopsis thaliana
  G1888,2nd Z-CO-like domain
CDICGERRALLFCQEDRAILCRECDIPIHQANEHTKKHNRFLL

SEQ ID NO: 2867 - protein, 58 aa, Arabidopsis thaliana
  G189,WRKY domain
PDDYSWRKYGQKPIKGSPHPRGYYKCSSVRGCPARKHVERAADDSSMLIVTYEGDHNH

SEQ ID NO: 2868 - protein, 43 aa, Arabidopsis thaliana
  G1896,Z-Dof domain
CPRCNSPNTKFCYYNNYSLSQPRHFCKSCRRYWTRGGALRNVP

SEQ ID NO: 2869 - protein, 29 aa, Arabidopsis thaliana
  G1898,Z-Dof domain
CPRCNSTTTKFCYYNNYNLAQPRYYCKSC

SEQ ID NO: 2870 - protein, 68 aa, Arabidopsis thaliana
  G19,AP2 domain
KNVYRGIRKRPWGKWAAEIRDPRKGVRVWLGTFNTAEEAAMAYDVAAKQIRGDKAKLNFPDLHHPPPP

SEQ ID NO: 2871 - protein, 60 aa, Arabidopsis thaliana
  G190,WRKY domain
YDGYLWRKYGQKSIKKSNHQRSYYRCSYNKDHNCEARKHEQKIKDNPPVYRTTYFGHHTC

SEQ ID NO: 2872 - protein, 47 aa, Arabidopsis thaliana
  G1903,Z-Dof domain
CPRCESANTKFCYYNNYNVNQPRYFCRNCQRYWTAGGSMRNVPVGSG

SEQ ID NO: 2873 - protein, 29 aa, Arabidopsis thaliana
  G1906,Z-Dof domain
CPRCDSTNTKFCYFNNYSLTQPRHFCKTC

SEQ ID NO: 2874 - protein, 27 aa, Arabidopsis thaliana
  G1917,GATA/Zn domain
CANCDTTSTPLWRNGPRGPKSLCNACG

SEQ ID NO: 2875 - protein, 139 aa, Arabidopsis thaliana
  G1918,RING/C3HC4 domain
CGICSNIGDDDYDGDAVVVDGDLISTPFCSHKFCKACWSKYLKKNFFSVEKNHTAISCPDRDCRAAVGPETVEKLTVRDQAMYELYILKSYREKYLGWKLKLCPARGCNYVIEFHLASEDEEHSLNIVCLCGHIFCWRC

SEQ ID NO: 2876 - protein, 131 aa, Arabidopsis thaliana
  G1923,NAC domain
PGFRFHPTDEELVGYYLSKKVLLKKTSKIDEIVSQIDIYKFDPWDLPRSRNTEKESYFFCKRGRKYRNSIRPNRVTGSGFWKATGIDKPVYSDGSNKAVIGLKKTLVYYLGSAGKGNKTDWMMHEFRLPTA

SEQ ID NO: 2877 - protein, 145 aa, Arabidopsis thaliana
  G1925,NAC domain
PPGFRFHPTDEELITHYLCRKVSDIGFTGKAVVDVDLNKCEPWDLPAKASMGEKEWYFFSQRDRKYPTGLRTNRATEAGYWKTTGKDKEIYRSGVLVGMKKTLVFYKGRAPKGEKSNWVMHEYRLESKQPFNPTNKEEWVVCRVF

SEQ ID NO: 2878 - protein, 59 aa, Arabidopsis thaliana
  G1933,1st WRKY domain
DDGYNWRKYGQKPIKGCEYPRSYYKCTHVNCPVKKKVERSSDGQITQIIYKGQHDHERP

SEQ ID NO: 2879 - protein, 61 aa, Arabidopsis thaliana
  G1933,2nd WRKY domain
DDGYRWRKYGQKVVKGNPHPRSYYKCTTPNCTVRKHVERASTDAKAVITTYEGKHNHDVPA

SEQ ID NO: 2880 - protein, 66 aa, Arabidopsis thaliana
  G1936,PCF domain
KKKPNKDRHLKVEGRGRRVRLPPLCAARIYQLTKELGHKSDGETLEWLLQHAEPSILSATVNGIKP

SEQ ID NO: 2881 - protein, 57 aa, Arabidopsis thaliana
  G194,WRKY domain
EDGYRWRKYGQKAVKNSPFPRSYYRCTTASCNVKKRVERSFRDPSTVVTTYEGQHTH

SEQ ID NO: 2882 - protein, 9 aa, Arabidopsis thaliana
  G1944,1st AT-hook domain
KKKRGRPRK

SEQ ID NO: 2883 - protein, 116 aa, Arabidopsis thaliana
  G1944,2nd AT-hook domain
FTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSF

SEQ ID NO: 2884 - protein, 92 aa, Arabidopsis thaliana
  G1947,HS domain
AFLTKTYNIVEDSSTNNIVSWSRDNNSFIVWEPETFALICLPRCFKHNNFSSFVRQLNTYGFKKIDTERWEFANEHFLKGERHLLKNIKRRK

SEQ ID NO: 2885 - protein, 164 aa, Arabidopsis thaliana
  G1950,AKR domain
LLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRP

SEQ ID NO: 2886 - protein, 92 aa, Arabidopsis thaliana
  G1957,ABI3/VP-1 domain
KEHMFDKVVTPSDVGKLNRLVIPKQHAERYFPLDSSNNQNGTLLNFQDRNGKMWRFRYSYWNSSQSYVMTKGWSRFVKEKKLDAGDIVSFQR

SEQ ID NO: 2887 - protein, 52 aa, Arabidopsis thaliana
  G1959,GARP domain
WTTELHERFVDAVTQLGGPDKATPKTIMRTMGVKGLTLYHLKSHLQKFRLGR

SEQ ID NO: 2888 - protein, 29 aa, Arabidopsis thaliana
  G1965,Z-Dof domain
CARCDSDNTKFCYYNNYSEFQPRYFCKNC

SEQ ID NO: 2889 - protein, 21 aa, Arabidopsis thaliana
  G1969,1st Z-C2H2 domain
CKICGKSFECYQALGGHQRIH

SEQ ID NO: 2890 - protein, 24 aa, Arabidopsis thaliana
  G1969,2nd Z-C2H2 domain
CYECKVCGKIFGCYRGLGGHTKLH

SEQ ID NO: 2891 - protein, 23 aa, Arabidopsis thaliana
  G1969,3rd Z-C2H2 domain
CHCKICGKSFVCSQGLGNHKRVH

SEQ ID NO: 2892 - protein, 23 aa, Arabidopsis thaliana
  G1972,1st Z-C2H2 domain
HICCECGKRFVSGKALGGHKRIH

SEQ ID NO: 2893 - protein, 21 aa, Arabidopsis thaliana
  G1972,2nd Z-C2H2 domain
CCVCYKKFTSMKALYGHMRFH

SEQ ID NO: 2894 - protein, 23 aa, Arabidopsis thaliana
  G1972,3rd Z-C2H2 domain
HVCVTCNKSFSSYQALGGHRASH

SEQ ID NO: 2895 - protein, 23 aa, Arabidopsis thaliana
  G1972,4th Z-C2H2 domain
HVCNICHKSFSTGQALGGHKRCH

SEQ ID NO: 2896 - protein, 113 aa, Arabidopsis thaliana
  G1981,Z-C3H domain
DYCYDSDSEDPYAGDHFRMYEFKIRRCTRSRSHDWTDCPFSHPGEKARRRDPRRFHYTGEVCPEFSRHGDCSRGDECGFAHGVFECWLHPSRYRTEACKDGKHCKRKVCFFAH

SEQ ID NO: 2897 - protein, 21 aa, Arabidopsis thaliana
  G1987,Z-C2H2 domain
CSVCNKTFNRFNNMQMHMWGH

SEQ ID NO: 2898 - protein, 21 aa, Arabidopsis thaliana
  G1990,1st Z-C2H2 domain
CKTCDRTFPSFQALGGHRASH

SEQ ID NO: 2899 - protein, 23 aa, Arabidopsis thaliana
  G1990,2nd Z-C2H2 domain
HECGICGAEFTSGQALGGHMRRH

SEQ ID NO: 2900 - protein, 21 aa, Arabidopsis thaliana
  G1991,1st Z-C2H2 domain
CEICNQGFQRDQNLQMHRRRH

SEQ ID NO: 2901 - protein, 26 aa, Arabidopsis thaliana
  G1991,2nd Z-C2H2 domain
CERCSKGYAVQSDYKAHLKTCGTRGH

SEQ ID NO: 2902 - protein, 23 aa, Arabidopsis thaliana
  G1991,3rd Z-C2H2 domain
CHNCKQHFQAPAALVPPPPQTHC

SEQ ID NO: 2903 - protein, 67 aa, Arabidopsis thaliana
  G2,1st AP2 domain
SSQYRGVTFYRRTGRWESHIWDCGKQVYLGGFDTAHAAARAYDRAAIKFRGVEADINFNIDDYDDDL

SEQ ID NO: 2904 - protein, 68 aa, Arabidopsis thaliana
  G2,2nd AP2 domain
SSKYRGVTLHKCGRWEARMGQFLGKKYVYLGLFDTEVEAARAYDKAAIKCNGKDAVTNFDPSIYDEEL

SEQ ID NO: 2905 - protein, 77 aa, Arabidopsis thaliana
  G20,AP2 domain
SSIYRGVTRHRWTGRYEAHLWDKSTWNQNQNKKGKQVYLGAYDDEEAAARAYDLAALKYWGPGTLINFPVTDYTRDL

SEQ ID NO: 2906 - protein, 43 aa, Arabidopsis thaliana
  G2005,Z-Dof domain
CPRCDSSNTKFCYYNNYSLSQPRHFCKACKRYWTRGGTLRNVP

SEQ ID NO: 2907 - protein, 105 aa, Arabidopsis thaliana
  G2007,MYB-(R1)R2R3 domain
KGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLK

SEQ ID NO: 2908 - protein, 92 aa, Arabidopsis thaliana
  G2011,HS domain
PFLSKTFDLVDDPTLDPVISWGLTGASFVVWDPLEFARIILPRNFKHNNFSSFVRQLNTYGFRKIDTDKWEFANEAFLRGKKHLLKNIHRRR

SEQ ID NO: 2909 - protein, 324 aa, Arabidopsis thaliana
  G2015,AKR domain
TGDSILHLAVTWGHLELVKEIVCECPRLLLEQNSSGQTPLHVAAHSGHTTIVEAFVALVTFSSARLCNEESERMNPYVLKDKDGNTALYYAIEGRYFEMAVCLVNANQDAPFLGNKYGVSSLFVAINTGDVSLVKAILKIIGNKDLKGKKSNLESKLQGQKSLAHVALVTQSIGLFFALTSSSCIYSIQICKTSLRREFPPQGGVLDVILDEYPSLMDERDINGWTCLSLAAHIGYYEGVCNLLERSTKAAEKGHENIVEEFIKRCPAKNGKFWISNMLIINKDTEHLGVGQDVDGNTPLHLAVMNWHFKSITWLARSSKILKV

SEQ ID NO: 2910 - protein, 316 aa, Arabidopsis thaliana
  G2018,AKR domain
KCPGLLLKSNMMGEVALHLAAEAGHLDVVWNLIDFINDISCTNLPVAKRIYFAKNKNQDTALHVALKGKHEVVASYLVSAAKSLSFVANRDGFSPLYLAIEAGHTSLVTTMCHGTNELSSKVGGRSIVHAALKANRKDILDALLSKDASLINLRDEGRTSLSFGASIGYYQGFSYLFDKNRDKVYVSDDDGLFPTHMAAKYGHVQILEEILKHCPEAIELLDRDGQNILHLAAKYGKLKVIKFILSCCKDKNKKKLINEQDVNGNTPLHLATINWHPKVVSMFTWDHRVDLKKRNYIGFTALDVAEENIDSSYIVH

SEQ ID NO: 2911 - protein, 365 aa, Arabidopsis thaliana
  G2020,AKR domain
GGDSVLHLAAASGHLELVKNIITECPCLLLEPNSKYQIPLHVAARAGRSAVVKALVASVLYFSPRVPEEDRDRLNIYVLKDIDGDTPLHAALKDLHEKAEERIRKLSLSHLIMHWRRSRCISFSDASTRQMETAACLVNADQHASFLANKDGTSPLYLAVEAGNVSLVRAMLNRPGNKIQGKTSTLASQLEGRKSLLHAALKAKNTDVLNVILNDDPSLVNERDEEGRTCLSVGASMGYYKGICKLLDRSTKSVYECDKDGSFPIHMAVEKGHLKVVKEILKRCPDSKELVNKQGQNMLHIAAKSAKVGSFLLGYIRRLDTENHLIEEQDVDGNAPLHLATINWRCRTVDKLAAFASTETKILNI

SEQ ID NO: 2912 - protein, 49 aa, Arabidopsis thaliana
  G204,MYB-related domain
QKWTPEEEAALKAGVLKHGTGKWRTILSDTEFSLILKSRSNVDLKDKWR

SEQ ID NO: 2913 - protein, 147 aa, Arabidopsis thaliana
  G2053,NAC domain
GLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGD

SEQ ID NO: 2914 - protein, 58 aa, Arabidopsis thaliana
  G2057,TEO domain
KDRHSKVCTAKGPRDRRVRLSAHTAIQFYDVQDRLGFDRPSKAVDWLIKKAKTSIDEL

SEQ ID NO: 2915 - protein, 68 aa, Arabidopsis thaliana
  G2059,AP2 domain
TKLYRGVRQRHWGKWVAEIRLPRNRTRVWLGTFETAEQAAMAYDTAAYILRGEFAHLNFPDLKHQLKS

SEQ ID NO: 2916 - protein, 104 aa, Arabidopsis thaliana
  G206,MYB-(R1)R2R3 domain
KKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRL

SEQ ID NO: 2917 - protein, 57 aa, Arabidopsis thaliana
  G2061,MADS domain
MTRKKVKLVWIENDKSRATSLQKMRVGLLKKVKELTILCAVRAIVIIFSPDKVGPLV

SEQ ID NO: 2918 - protein, 56 aa, Arabidopsis thaliana
  G2062,MADS domain
GKQKINIKKIEKDEDRSVTLSKRLNAIYTMIIELSILCGVEVAFIGYSCSGKPYTF

SEQ ID NO: 2919 - protein, 57 aa, Arabidopsis thaliana
  G2063,MADS domain
KGKQKINIKKIEKDEGRSVTFSKRLNGIYTKISELSILCGVEVAFIGYSCSGKPYTF

SEQ ID NO: 2920 - protein, 118 aa, Arabidopsis thaliana
  G2068,bZIP domain
SDQNRNADVLMITNTDSGGANDAKKYKRMLANRASAARSKENREKKIRDMELRVETLENTQASLFGTMTLLEKENIVMMNENKLAKIRLQLLEQQAPLLTAFIFFVFVALTKQLDELR

SEQ ID NO: 2921 - protein, 52 aa, Arabidopsis thaliana
  G2071,bZIP domain
LEKVVERRQKRMIKNRESAARSRARKQAYTLELEAEIESLKLVNQDLQKKQA

SEQ ID NO: 2922 - protein, 60 aa, Arabidopsis thaliana
  G2072,bZIP domain
QNAHRARLRRLEYISDLERTIQVLQVEGCEMSSAIHYLDQQLLMLSMENRALKQRMDSLA

SEQ ID NO: 2923 - protein, 132 aa, Arabidopsis thaliana
  G2084,RING/C3HC4 domain
ELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQH

SEQ ID NO: 2924 - protein, 28 aa, Arabidopsis thaliana
  G2085,GATA/Zn domain
CTHCGISSKCTPMMRRGPSGPRTLCNAC

SEQ ID NO: 2925 - protein, 49 aa, Arabidopsis thaliana
  G2086,RING/C3HC4 domain
ARKLETDFVLTGEEDDDALPLACSICQNPFLDPVVTNCNHYFCDKCALK

SEQ ID NO: 2926 - protein, 47 aa, Arabidopsis thaliana
  G209,MYB-related domain
RNFSKDEDDLILKLHALLGNRWSLIAGRLPGRTDNEVRIHWETYLKR

SEQ ID NO: 2927 - protein, 33 aa, Arabidopsis thaliana
  G2092,RING/C3HC4 domain
CPLCRGHIKEWVVVKAARCFMNSKHRSCSCETC

SEQ ID NO: 2928 - protein, 26 aa, Arabidopsis thaliana
  G2094,GATA/Zn domain
CAICGTSKTPLWRGGPAGPKSLCNAC

SEQ ID NO: 2929 - protein, 68 aa, Arabidopsis thaliana
  G21,AP2 domain
HPTYRGVRMRSWGKWVSEIREPRKKSRIWLGTYPTAEMAARAHDVAALAIKGTTAYLNFPKLAGELPR

SEQ ID NO: 2930 - protein, 101 aa, Arabidopsis thaliana
  G210,MYB-(R1)R2R3 domain
KGPWTPEEDQKLLAYIEEHGHGSWRSLPEKAGLHRCGKSCRLRWTNYLRPDIKRGKFNLQEEQTIIQLHALLGNRWSAIATHLPKRTDNEIKNYWNTHLKK

SEQ ID NO: 2931 - protein, 54 aa, Arabidopsis thaliana
  G2105,TH domain
VRSRLDHKFKEANQKGPLWDEVSRIMSEEHGYTRSGKKCREKFENLYKYYKKTK

SEQ ID NO: 2932 - protein, 68 aa, Arabidopsis thaliana
  G2107,AP2 domain
HPIYRGVRRRDGDKWVCEVREPIHQRRVWLGTYPTADMAARAHDVAVLALRGRSACLNFSDSAWRLPV

SEQ ID NO: 2933 - protein, 68 aa, Arabidopsis thaliana
  G2108,AP2 domain
EGKYLGVRRRPWGRYAAEIRNPFTKERHWLGTFDTAEEAAFAYDVAARSISGSLATTNFFYTENTSLE

SEQ ID NO: 2934 - protein, 57 aa, Arabidopsis thaliana
  G2109,MADS domain
MGRVKLKIKRLESTSNRQVTYTKRKNGILKKAKELSILCDIDIVLLMFSPTGRATAF

SEQ ID NO: 2935 - protein, 114 aa, Arabidopsis thaliana
  G211,MYB-(R1)R2R3 domain
KRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTH

SEQ ID NO: 2936 - protein, 61 aa, Arabidopsis thaliana
  G2116,bZIP domain
KRAKRILANRQSAARSKERKARYIQELERKVQSLQTEATTLSAQLTLYQRDTNGLANENTE

SEQ ID NO: 2937 - protein, 61 aa, Arabidopsis thaliana
  G2117,bZIP domain
ERKRRRKVSNRESARRSRMRKQRHMEELWSMLVQLINKNKSLVDELSQARECYEKVIEENM

SEQ ID NO: 2938 - protein, 97 aa, Arabidopsis thaliana
  G2121,VAR domain
GNYIVTIGIGTPKHDLSLVFDTGSDLTWTQCEPCLGSCYSQKEPKFNPSSSSTYQNVSCSSPMCEDAESCSASNCVYSIVYGDKSFTQGFLAKEKFT

SEQ ID NO: 2939 - protein, 70 aa, Arabidopsis thaliana
  G2129,bZIP domain
ERKKKRKLSNRESAKRSREKKQKHLEEMSIQLNQLKIQNQELKNQLRYVLYHCQRTKMENDRLLMEHRIL

SEQ ID NO: 2940 - protein, 69 aa, Arabidopsis thaliana
  G2130,AP2 domain
KPKKYRGVRQRPWGKFAAEIRDPSSRTRIWLGTFVTAEEAAIAYDRAAIHLKGPKALTNFLTPPTPTPV

SEQ ID NO: 2941 - protein, 68 aa, Arabidopsis thaliana
  G2132,AP2 domain
SSGFKGVRRRPWGKFAAEIRNPFEKKRKWLGTFPTEEEAAEAYQKSKREFDERLGLVKQEKDLVDLTK

SEQ ID NO: 2942 - protein, 68 aa, Arabidopsis thaliana
  G2135,AP2 domain
SSRYKGIRRRPWGRWAAEIRDPIKGVRVWLGTFNTAEEAARAYDLEAKRIRGAKAKLNFPNESSGKRK

SEQ ID NO: 2943 - protein, 56 aa, Arabidopsis thaliana
  G2139,MADS domain
GKQKIEMKKVENYGDRMITFSKRKTGIFKKMNELVAMCDVEVAFLIFSQPKKPYTF

SEQ ID NO: 2944 - protein, 59 aa, Arabidopsis thaliana
  G2141,HLH/MYC domain
RRGQATNSHSLAERVRREKISERMKFLQDLVPGCNKVTGKAVMLDEIINYVQSLQRQVE

SEQ ID NO: 2945 - protein, 59 aa, Arabidopsis thaliana
  G2144,HLH/MYC domain
RRGQATDSHSLAERARREKINARMKLLQELVPGCDKIQGTALVLDEIINHVQSLQRQVE

SEQ ID NO: 2946 - protein, 58 aa, Arabidopsis thaliana
  G2145,HLH/MYC domain
TKGTATDPQSLYARKRREKINERLKTLQNLVPNGTKVDISTMLEEAVHYVKFLQLQIK

SEQ ID NO: 2947 - protein, 58 aa, Arabidopsis thaliana
  G2147,HLH/MYC domain
RRGRAAAIHNESERRRRDRINQRMRTLQKLLPTASKADKVSILDDVIEHLKQLQAQVQ

SEQ ID NO: 2948 - protein, 58 aa, Arabidopsis thaliana
  G2148,HLH/MYC domain
NRGIASDPQSLYARKRRERINDRLKTLQSLVPNGTKVDISTMLEDAVHYVKFLQLQIK

SEQ ID NO: 2949 - protein, 59 aa, Arabidopsis thaliana
  G2150,HLH/MYC domain
RRGQATDSHSLAERARREKISERMTLLQDLVPGCNRITGKAVMLDEIINYVQSLQRQVE

SEQ ID NO: 2950 - protein, 9 aa, Arabidopsis thaliana
  G2154,1st AT-hook domain
KRKRGRPRK

SEQ ID NO: 2951 - protein, 113 aa, Arabidopsis thaliana
  G2154,2nd AT-hook domain
FTPHIVNIAPGEDVVQKIMMFANQSKHELCVLSASGTISNASLRQPAPSGGNLPYEGQYEILSLSGSYIRTEQGGKSGGLSVSLSASDGQIIGGAIGSHLTAAGPVQVILGTF

SEQ ID NO: 2952 - protein, 9 aa, Arabidopsis thaliana
  G2156,1st AT-hook domain
KRPRGRPPG

SEQ ID NO: 2953 - protein, 152 aa, Arabidopsis thaliana
  G2156,2nd AT-hook domain
SKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLED

SEQ ID NO: 2954 - protein, 9 aa, Arabidopsis thaliana
  G2157,1st AT-hook domain
RRPRGRPPG

SEQ ID NO: 2955 - protein, 144 aa, Arabidopsis thaliana
  G2157,2nd AT-hook domain
SKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEE

SEQ ID NO: 2956 - protein, 103 aa, Arabidopsis thaliana
  G216,MYB-(R1)R2R3 domain
VKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKP

SEQ ID NO: 2957 - protein, 48 aa, Arabidopsis thaliana
  G217,MYB-related domain
GVWKNTEDEILKAAVMKYGKNQWARISSLLVRKSAKQCKARWYEWLDP

SEQ ID NO: 2958 - protein, 49 aa, Arabidopsis thaliana
  G219,MYB-related domain
TPWTEEEHRLFLTGLHKVGKGDWRGISRNFVKTRTPTQVASHAQKYFLR

SEQ ID NO: 2959 - protein, 65 aa, Arabidopsis thaliana
  G22,AP2 domain
KGMQYRGVRRRPWGKFAAEIRDPKKNGARVWLGTYETPEDAAVAYDRAAFQLRGSKAKLNFPHLI

SEQ ID NO: 2960 - protein, 50 aa, Arabidopsis thaliana
  G2213,bZIP-NIN domain
FFDRPIMKAAKELNVGLTVLKKRCRELGIYRWPHRKLKSLNSLIKNLKNV

SEQ ID NO: 2961 - protein, 97 aa, Arabidopsis thaliana
  G2215,bZIP-NIN domain
QAAIALNVGLTLLKRRCRELGIRRWPHRKLMSLNTLISNVKELQKMEGEENAEKLQDALEMLEKEKRTIEDLPDLEFKDKTKRLRQACFKANHKRKK

SEQ ID NO: 2962 - protein, 107 aa, Arabidopsis thaliana
  G222,MYB-(R1)R2R3 domain
RKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRK

SEQ ID NO: 2963 - protein, 41 aa, Arabidopsis thaliana
  G2223,RING/C3H2C3 domain
CCICLCEYEDGVELRELPCNHHFHCTCIDKWLHINSRCPLC

SEQ ID NO: 2964 - protein, 42 aa, Arabidopsis thaliana
  G2226,RING/C3H2C3 domain
CSVCLSKFQGDSEINKLKCGHLFHKTCLEKWIDYWNITCPLC

SEQ ID NO: 2965 - protein, 42 aa, Arabidopsis thaliana
  G2237,RING/C3H2C3 domain
CSICLSELVKGDKARLLPKCNHSFHVECIDMWFQSHSTCPIC

SEQ ID NO: 2966 - protein, 42 aa, Arabidopsis thaliana
  G2238,RING/C3H2C3 domain
CSVCLSEFEEDDEGRVLPKCGHVFHVDCIDTWFRSRSSCPLC

SEQ ID NO: 2967 - protein, 42 aa, Arabidopsis thaliana
  G2239,RING/C3H2C3 domain
CAICLNEFEDDETLRLLPKCDHVFHPHCIDAWLEAHVTCPVC

SEQ ID NO: 2968 - protein, 45 aa, Arabidopsis thaliana
  G225,MYB-related domain
VKMSEEEEDLISRMYKLVGDRWELIAGRIPGRTPEEIERYWLMKH

SEQ ID NO: 2969 - protein, 44 aa, Arabidopsis thaliana
  G2251,RING/C3H2C3 domain
CAVCLYDFENDDEIRRLTNCRHIFHRGCLDRWMMGYNQMTCPLC

SEQ ID NO: 2970 - protein, 41 aa, Arabidopsis thaliana
  G2252,RING/C3H2C3 domain
CAVCKDGMVMGETGKKLPCGHCYHGDCIVPWLGTRNSCPVC

SEQ ID NO: 2971 - protein, 42 aa, Arabidopsis thaliana
  G2269,RING/C3H2C3 domain
CSICLCEYMEEEMLRMMPECKHYFHVYCLDAWLKLNGSCPVC

SEQ ID NO: 2972 - protein, 101 aa, Arabidopsis thaliana
  G227,MYB-(R1)R2R3 domain
KGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRK

SEQ ID NO: 2973 - protein, 107 aa, Arabidopsis thaliana
  G229,MYB-(R1)R2R3 domain
RGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFI

SEQ ID NO: 2974 - protein, 59 aa, Arabidopsis thaliana
  G2290,WRKY domain
EDGYRWRKYGQKAVKNSPFPRSYYRCTNSRCTVKKRVERSSDDPSIVITTYEGQHCHQT

SEQ ID NO: 2975 - protein, 68 aa, Arabidopsis thaliana
  G2291,AP2 domain
TGGFMGVRKRPWGRWSAEIRDRIGRCRHWLGTFDTAEEAARAYDAAARRLRGTKAKTNFVIPPLFPKE

SEQ ID NO: 2976 - protein, 61 aa, Arabidopsis thaliana
  G2293,WRKY domain
SDSWAWRKYGQKPIKGSPYPRGYYRCSSTKGCPARKQVERSRDDPTMILITYTSEHNHPWP

SEQ ID NO: 2977 - protein, 57 aa, Arabidopsis thaliana
  G2295,MADS domain
MVPKVVDLQRIANDKTRITTYKKRKASLYKKAQEFSTLCGVETCLIVYGPTKATDVV

SEQ ID NO: 2978 - protein, 61 aa, Arabidopsis thaliana
  G2296,WRKY domain
IDGFIWRKYGQKTIKTSPHQRWYYRCAYAKDQNCDATKRVQKIQDNPPVYRNTYVGQHACE

SEQ ID NO: 2979 - protein, 68 aa, Arabidopsis thaliana
  G2299,AP2 domain
HPVYRGVRMRNWGKWVSEIREPRKKSRIWLGTFPTPEMAARAHDVAALSIKGTAAILNFPELADSFPR

SEQ ID NO: 2980 - protein, 506 aa, Arabidopsis thaliana
  G2304,AKR domain
DYIPCLDNEEAIMKLRSRRHFEHRERHCPEDPPTCLVPLPEGYKEAIKWPESRDKIWYHNVPHTKLAEVKGHQNWVKVTGEFLTFPGGGTQFIHGALHYIDFLQQSLKNIAWGKRTRVILDVGCGVASFGGFLFERDVIAMSLAPKDEHEAQVQFALERKIPAISAVMGSKRLPFPSRVFDLIHCARCRVPWHNEGGMLLLELNRMLRPGGYFVWSATPVYQKLEEDVQIWKEMSALTKSLCWELVTINKDKLNGIGAAIYQKPATNECYEKRKHNKPPLCKNNDDANAAWYVPLQACMHKVPTNVVERGSKWPVNWPRRLQTPPYWLNSSQMGIYGKPAPRDFTTDYEHWKHVVSKVYMNEIGISWSNVRNVMDMRAVYGGFAAALKDLQVWVMNVVNINSPDTLPIIYERGLFGIYHDWCESFSTYPRSYDLLHADHLFSKLRTRCNLVPVMAEVDRIVRPGGKLIVRDESNVIREVENMLKSLHWDVHLTFSKHQEGILSAQK

SEQ ID NO: 2981 - protein, 49 aa, Arabidopsis thaliana
  G2313,MYB-related domain
NPWTEEEHRLFLQGLKKYGEGASTLTSTNFVKTKTPRQVSSHAQYYKRQ

SEQ ID NO: 2982 - protein, 57 aa, Arabidopsis thaliana
  G2315,PMR domain
TLPHHVVEDILERLPVKTLRKFKCVCSTWRSTIDSQRFKDRHMIHGQLLEDPDILLL

SEQ ID NO: 2983 - protein, 187 aa, Arabidopsis thaliana
  G2316,PMR domain
KQWRSTIESRSFEERHLKIVERSRVDFPQVMVMSEEYSLKGSKGNQPRPDTDIGFSTICLESASILSSTLITFPQGFQHRIYASESCDGLFCIHSLKTQAIYVVNPATRWFRQLPPARFQILMQKLYPTQDTWIDIKPVVCYTAFVKANDYKLVWLYNSDASNPNLGVTKCEVFDFRANAWRYLTCT

SEQ ID NO: 2984 - protein, 49 aa, Arabidopsis thaliana
  G2318,MYB-related domain
IPWTEEEHRLFLLGLDKFGKGDWRSISRNFVISRTPTQVASHAQKYFIR

SEQ ID NO: 2985 - protein, 102 aa, Arabidopsis thaliana
  G232,MYB-(R1)R2R3 domain
KGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKK

SEQ ID NO: 2986 - protein, 113 aa, Arabidopsis thaliana
  G2334,GRF-like domain
FFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVE

SEQ ID NO: 2987 - protein, 105 aa, Arabidopsis thaliana
  G2342,MYB-(R1)R2R3 domain
KGGWTPEEDETLRRAVEKYKGKRWKKIAEFFPERTEVQCLHRWQKVLNPELVKGPWTQEEDDKIVELVKKYGPAKWSVIAKSLPGRIGKQCRERWHNHLNPGIRK

SEQ ID NO: 2988 - protein, 103 aa, Arabidopsis thaliana
  G2343,MYB-(R1)R2R3 domain
RGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKI

SEQ ID NO: 2989 - protein, 60 aa, Arabidopsis thaliana
  G2344,CAAT domain
EPVFVNAKQYHGILRRRQSRARLESQNKVIKSRKPYLHESRHLHAIRRPRGCGGRFLNAK

SEQ ID NO: 2990 - protein, 103 aa, Arabidopsis thaliana
  G237,MYB-(R1)R2R3 domain
RKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKK

SEQ ID NO: 2991 - protein, 103 aa, Arabidopsis thaliana
  G2371,ABI3/VP-1 domain
RESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQR

SEQ ID NO: 2992 - protein, 61 aa, Arabidopsis thaliana
  G2373,TH domain
GGSGVGDVARAILGFTEAYEKAETAKLKLMAELEKERMKFAKEMELQRMQFLKTQLEITQN

SEQ ID NO: 2993 - protein, 100 aa, Arabidopsis thaliana
  G2376,1st TH domain
GREDCWSEAATAVLIDAWGERYLELSRGNLKQKHWKEVAEIVSSREDYGKIPKTDIQCKNRIDTVKKKYKQEKVRIANGGGRSRWVFFDKLDRLIGSTAK

SEQ ID NO: 2994 - protein, 73 aa, Arabidopsis thaliana
  G2376,2nd TH domain
EEKKKQDGDGVGNKWRELTRAIMRFGEAYEQTENAKLQQVVEMEKERMKFLKELELQRMQFFVKTQLEISQLK

SEQ ID NO: 2995 - protein, 94 aa, Arabidopsis thaliana
  G2377,1st TH domain
GREDWWSEDATATLIEAWGDRYVNLNRGNLRQNDWKEVADAVNSSHGNGRPKTDVQCKNRIDTLKKKYKTEKAKPLSNWCFFDRLDFLIGPVMK

SEQ ID NO: 2996 - protein, 85 aa, Arabidopsis thaliana
  G2377,2nd TH domain
DDAGDWGFVVRKHRKVEDVDSSEGSAFRELARSILKLGEAFERIEGKKQQMMIELEKQRMEVAKELELQRMNMLMEMQLELEKSK

SEQ ID NO: 2997 - protein, 105 aa, Arabidopsis thaliana
  G239,MYB-(R1)R2R3 domain
RKGPWTEEEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAK

SEQ ID NO: 2998 - protein, 41 aa, Arabidopsis thaliana
  G2394,RING/C3H2C3 domain
CCICLTRYGDDEQVRELPCSHVFHVDCVDKWLKINATCPLC

SEQ ID NO: 2999 - protein, 41 aa, Arabidopsis thaliana
  G2400,RING/C3H2C3 domain
CAICLDRFKKGETLVHLPCAHKFHSICLLPWLDTNVYCPYC

SEQ ID NO: 3000 - protein, 101 aa, Arabidopsis thaliana
  G241,MYB-(R1)R2R3 domain
RGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKK

SEQ ID NO: 3001 - protein, 51 aa, Arabidopsis thaliana
  G2417,GARP domain
RWTPELHEVFVDAVNQLGGSNEATPKGVLKHMKVEGLTIFHVKSHLQKYRT

SEQ ID NO: 3002 - protein, 101 aa, Arabidopsis thaliana
  G242,MYB-(R1)R2R3 domain
KGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRK

SEQ ID NO: 3003 - protein, 102 aa, Arabidopsis thaliana
  G2421,MYB-(R1)R2R3 domain
RKGAWTAEEDSLLRQCIGKYGEGKWHQVPLRAGLNRCRKSCRLRWLNYLKPSIKRGKFSSDEVDLLLRLHKLLGNRWSLIAGRLPGRTANDVKNYWNTHLSK

SEQ ID NO: 3004 - protein, 102 aa, Arabidopsis thaliana
  G2422,MYB-(R1)R2R3 domain
RKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHLSK

SEQ ID NO: 3005 - protein, 108 aa, Arabidopsis thaliana
  G2425,MYB-(R1)R2R3 domain
LRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKK

SEQ ID NO: 3006 - protein, 101 aa, Arabidopsis thaliana
  G2426,MYB-(R1)R2R3 domain
KGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKK

SEQ ID NO: 3007 - protein, 155 aa, Arabidopsis thaliana
  G2427,MYB-(R1)R2R3 domain
AKGGWTPEEDETLRQAVDTFKGKSWKNIAKSFPDRTEVQCLHRWQKVLNPDLIKGPWTHEEDEKIVELVEKYGPAKWSIIAQSLPGRIGKQCRERWHNHLNPDINKDAWTTEEEVALMNAHRSHGNKWAEIAKVLPGRTDNAIKNHWNSSLKKKS

SEQ ID NO: 3008 - protein, 117 aa, Arabidopsis thaliana
  G243,MYB-(R1)R2R3 domain
LKKGAWTTEEDKKLISYIHDHGEGGWRDIPEKAGLKRCGKSCRLRWTNYLKPDIKRGEFSYEEEQIIIMLHASRGNKWSVIARHLPKRTDNEVKNYWNTHLKKRLIDDGIDPVTHKP

SEQ ID NO: 3009 - protein, 28 aa, Arabidopsis thaliana
  G2437,GATA/Zn domain
CRHCGIGEKSTPMMRRGPAGPRTLCNAC

SEQ ID NO: 3010 - protein, 101 aa, Arabidopsis thaliana
  G245,MYB-(R1)R2R3 domain
KGPWTPEEDEKLVGYIQTHGPGKWRTLPKNAGLKRCGKSCRLRWTNYLRPDIKRGEFSLQEEETIIQLHRLLGNEWSAIAIHLPGRTDNEIKDYWNTHIKK

SEQ ID NO: 3011 - protein, 52 aa, Arabidopsis thaliana
  G2452,1st MYB-related domain
ATWTAEENKRFEKALAYLDDKDNLESWSKIADLIPGKTVADVIKRYKELEDD

SEQ ID NO: 3012 - protein, 49 aa, Arabidopsis thaliana
  G2452,2nd MYB-related domain
VPWTEDEHLRFLMGLKKYGKGDWRNIAKSFVTTRTPTQVASHAQKYFLR

SEQ ID NO: 3013 - protein, 40 aa, Arabidopsis thaliana
  G2454,1st YABBY domain
LCYVQCNFCQTILAVNVPYTSLFKTVTVRCGCCTNLLSVN

SEQ ID NO: 3014 - protein, 48 aa, Arabidopsis thaliana
  G2454,2nd YABBY domain
RPPEKRQRVPSAYNRFIKEEIQRIKAGNPDISHREAFSAAAKNWAHFP

SEQ ID NO: 3015 - protein, 39 aa, Arabidopsis thaliana
  G2457,1st YABBY domain
LYYVRCSICNTILAVGIPLKRMLDTVTVKCGHCGNLSFL

SEQ ID NO: 3016 - protein, 48 aa, Arabidopsis thaliana
  G2457,2nd YABBY domain
KPPEKKQRLPSAYNRFMRDEIQRIKSANPEIPHREAFSAAAKNWAKYI

SEQ ID NO: 3017 - protein, 103 aa, Arabidopsis thaliana
  G246,MYB-(R1)R2R3 domain
GHWTLSEDLKLKELVAVFGPQNWKFIGEKMEPRTSLSCRQRWFNQLDPKINKRNFTDEEEEKLLRAHILYGNKWSKIAKLFNRRTDHAVKNHWHSLMNRIIRK

SEQ ID NO: 3018 - protein, 225 aa, Arabidopsis thaliana
  G2462,E2F domain
GTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPEN

SEQ ID NO: 3019 - protein, 49 aa, Arabidopsis thaliana
  G2484,Z-C4HC3 domain
VCGACGDNYGTDEFWICCDACEKWFHGKCVKITPAKAEHIKHYKCPTCS

SEQ ID NO: 3020 - protein, 206 aa, Arabidopsis thaliana
  G2499,1st SWI/SNF domain
FQPILKPYQLVGVNFLLLLYKKGIEGAILADEMGLGKTIQAITYLTLLSRLNNDPGPHLVVCPASVLENWERELRKWCPSFTVLQYHGAARAAYSRELNSLSKAGKPPPFNVLLVCYSLFERHSEQQKDDRKVLKRWRWSCVLMDEAHALKDKNSYRWKNLMSVARNANQRLMLTGTPLQNDLHELWSLLEFMLPDIFTTENVDLK

SEQ ID NO: 3021 - protein, 84 aa, Arabidopsis thaliana
  G2499,2nd SWI/SNF domain
DILEWTLDVIGVTYRRLDGSTQVTDRQTIVDTFNNDKSIFACLLSTRAGGQGLNLTGADTVIIHDMDFNPQIDRQAEDRCHRIG

SEQ ID NO: 3022 - protein, 129 aa, Arabidopsis thaliana
  G2505,NAC domain
VPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRL

SEQ ID NO: 3023 - protein, 68 aa, Arabidopsis thaliana
  G2510,AP2 domain
HPVYHGVRKRRWGKWVSEIREPRKKSRIWLGSFPVPEMAAKAYDVAAFCLKGRKAQLNFPEEIEDLPR

SEQ ID NO: 3024 - protein, 54 aa, Arabidopsis thaliana
  G2519,HLH/MYC domain
MSHIAVERNRRRQMNEHLKSLRSLTPCFYIKRGDQASIIGGVIEFIKELQQLVQ

SEQ ID NO: 3025 - protein, 104 aa, Arabidopsis thaliana
  G2535,NAC domain
VPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMR

SEQ ID NO: 3026 - protein, 65 aa, Arabidopsis thaliana
  G2546,HB domain
RPAWRPQRGLPENSVSVLRAWLFEHFLHPYPKESEKIMLAKQTGLSKNQVANWFINARVRLWKPM

SEQ ID NO: 3027 - protein, 103 aa, Arabidopsis thaliana
  G255,MYB-(R1)R2R3 domain
KGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKL

SEQ ID NO: 3028 - protein, 64 aa, Arabidopsis thaliana
  G2550,HB domain
PAWRPQRGLPENSVSILRAWLFEHFLHPYPKESEKIMLSKQTGLSKNQVANWFINARVRLWKPM

SEQ ID NO: 3029 - protein, 58 aa, Arabidopsis thaliana
  G2552,HLH/MYC domain
KTKTDRSRTLISERRRRGRMKDKLYALRSLVPNITKMDKASIVGDAVLYVQELQSQAK

SEQ ID NO: 3030 - protein, 61 aa, Arabidopsis thaliana
  G2553,HLH/MYC domain
KKNKKRAKPGESSRPRPRDRQLIQDRIKELRELVPNGSKCSIDSLLERTIKHMLFLQNVTK

SEQ ID NO: 3031 - protein, 61 aa, Arabidopsis thaliana
  G2554,HLH/MYC domain
GVKKKRAKAGESRRPRPKDRQMIQDRIKELRGMIPNGAKCSIDTLLDLTIKHMVFMQSLAK

SEQ ID NO: 3032 - protein, 59 aa, Arabidopsis thaliana
  G2555,HLH/MYC domain
KRGCATHPRSIAERVRRTRISDRIRRLQELVPNMDKQTNTADMLEEAVEYVKALQSQIQ

SEQ ID NO: 3033 - protein, 61 aa, Arabidopsis thaliana
  G2556,HLH/MYC domain
KKNKKRAKPGESSRPRPRDRQLIQDRIKELRELVPNGSKCSIDSLLECTIKHMLFLQSVSQ

SEQ ID NO: 3034 - protein, 68 aa, Arabidopsis thaliana
  G2573,AP2 domain
TCTFRGVRQRTWGKWVAEIREPNRGTRLWLGTFNTSVEAAMAYDEAAKKLYGHEAKLNLVHPQQQQQV

SEQ ID NO: 3035 - protein, 60 aa, Arabidopsis thaliana
  G2574,WRKY domain
TMNDGCQWRKYGQKIAKGNPCPRAYYRCTVAPGCPVRKQVQRCADDMSILITTYEGTHSH

SEQ ID NO: 3036 - protein, 56 aa, Arabidopsis thaliana
  G2575,WRKY domain
DGYRWRKYGQKAVKNSPYPRSYYRCTTQKCNVKKRVERSFQDPSIVITTYEGKHNH

SEQ ID NO: 3037 - protein, 74 aa, Arabidopsis thaliana
  G2577,1st AP2 domain
TSIYRGVTRHRWTGRYEAHLWDNSCKREGQTRKGRQGGYDKEEKAARAYDLAALKYWGTTTTTNFPLSEYEKEV

SEQ ID NO: 3038 - protein, 69 aa, Arabidopsis thaliana
  G2577,2nd AP2 domain
ASIYRGVTRHHQHGRWQARIGRVAGNKDLYLGTFGTQEEAAEAYDIAAIKFRGLSAVTNFDMNRYNVKA

SEQ ID NO: 3039 - protein, 68 aa, Arabidopsis thaliana
  G2579,AP2 domain
PGRFLGVRRRPWGRYAAEIRDPTTKERHWLGTFDTAHEAALAYDRAALSMRGTQARTNFVYTPTDVHT

SEQ ID NO: 3040 - protein, 101 aa, Arabidopsis thaliana
  G258,MYB-(R1)R2R3 domain
RGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKK

SEQ ID NO: 3041 - protein, 57 aa, Arabidopsis thaliana
  G2582,MADS domain
MARKKVRAAWIRDDRMRRASLKRRLTGLIKKVNELSILCDMRASVVVFNREEEQLTA

SEQ ID NO: 3042 - protein, 58 aa, Arabidopsis thaliana
  G2586,WRKY domain
DDGFTWRKYGQKTIKTSPYQRCYYRCTYAKDQNCNARKRVQMIQDNPPVYRTTYLGKH

SEQ ID NO: 3043 - protein, 92 aa, Arabidopsis thaliana
  G259,HS domain
PFLVKTYKVVEDPTTDGVISWNEYGTGFVVWQPAEFARDLLPTLFKHCNFSSFVRQLNTYGFRKVTTIRWEFSNEMFRKGQRELMSNIRRRK

SEQ ID NO: 3044 - protein, 68 aa, Arabidopsis thaliana
  G26,AP2 domain
QRNYRGVRQRPWGKWAAEIRDPNKAARVWLGTFDTAEEAALAYDKAAFEFRGHKAKLNFPEHIRVNPT

SEQ ID NO: 3045 - protein, 31 aa, Arabidopsis thaliana
  G2604,1st Z-LSDlike domain
QLVCSGCRNLLMYPVGATSVCCAVCNAVTAV

SEQ ID NO: 3046 - protein, 31 aa, Arabidopsis thaliana
  G2604,2nd Z-LSDlike domain
QLVCGGCHTLLMYIRGATSVQCSCCHTVNLA

SEQ ID NO: 3047 - protein, 21 aa, Arabidopsis thaliana
  G2606,1st Z-C2H2 domain
CKTCDKSFHSFQALGGHRASH

SEQ ID NO: 3048 - protein, 23 aa, Arabidopsis thaliana
  G2606,2nd Z-C2H2 domain
HECSICKAEFSSGQALGGHMRRH

SEQ ID NO: 3049 - protein, 92 aa, Arabidopsis thaliana
  G261,HS domain
PFLTKTYEMVDDSSSDSIVSWSQSNKSFIVWNPPEFSRDLLPRFFKHNNFSSFIRQLNTYGFRKADPEQWEFANDDFVRGQPHLMKNIHRRK

SEQ ID NO: 3050 - protein, 61 aa, Arabidopsis thaliana
  G2616,HB domain
RWTPTTTQLQILENIYKEGSGTPNPRRIKEITMELSEHGQIMEKNVYHWFQNRRARSKRKQ

SEQ ID NO: 3051 - protein, 92 aa, Arabidopsis thaliana
  G262,HS domain
PFLSKTYDMVEDPATDAIVSWSPTNNSFIVWDPPEFSRDLLPKYFKHNNFSSFVRQLNTYGFRKVDPDRWEFANEGFLRGQKHLLKKISRRK

SEQ ID NO: 3052 - protein, 76 aa, Arabidopsis thaliana
  G2620,TH domain
KWTDKMVKLLITAVSYIGDDSSIDSSSRRKFAVLQKKGKWKSVSKVMAERGYHVSPQQCEDKFNDLNKRYKKLNDM

SEQ ID NO: 3053 - protein, 58 aa, Arabidopsis thaliana
  G2632,CAAT domain
EPVFVNAKQYQAILRRRQARAKAELEKKLIKSRKPYLHESRHQHAMRRPRGTGGRFAK

SEQ ID NO: 3054 - protein, 54 aa, Arabidopsis thaliana
  G2639,SRS domain
GSGGPSCQDCGNQSKKDCSHMRCRTCCKSRGLDCPTHVKSTWVPAAKRRERQQQ

SEQ ID NO: 3055 - protein, 92 aa, Arabidopsis thaliana
  G264,HS domain
PFLVKTYEMVDDSSTDQIVSWSANNNSFIVWNHAEFSRLLLPTYFKHNNFSSFIRQLNTYGFRKIDPERWEFLNDDFIKDQKHLLKNIHRRK

SEQ ID NO: 3056 - protein, 44 aa, Arabidopsis thaliana
  G2640,SRS domain
DCGNQAKKDCSHMRCRTCCKSRGFECSTHVRSTWVPAAKRRERQ

SEQ ID NO: 3057 - protein, 92 aa, Arabidopsis thaliana
  G265,HS domain
PFLTKTYEMVDDSSSDSVVAWSENNKSFIVKNPAEFSRDLLPRFFKHKNFSSFIRQLNTYGFRKVDPEKWEFLNDDFVRGRPYLMKNIHRRK

SEQ ID NO: 3058 - protein, 58 aa, Arabidopsis thaliana
  G2650,TEO domain
KDRHSKVCTVRGLRDRRIRLSVMTAIQVYDLQERLGLSQPSKVIDWLLEVAKNDVDLL

SEQ ID NO: 3059 - protein, 60 aa, Arabidopsis thaliana
  G2655,HLH/MYC domain
EIENQRMTHIAVERNRRKQMNEYLAVLRSLMPPYYAQRGDQASIVGGAINYLKELEHHLQ

SEQ ID NO: 3060 - protein, 120 aa, Arabidopsis thaliana
  G2656,DBP domain
TTASVQRVKREEVEAKITAWQTAKVAKINNRFKRQDAVINGWLNEQVHRANSWMKKIERKLEDRRAKAMEKTQNKVAKAQRKAEERRATAEGKRGTEVARVLEVANLMRAVGRPPAKRSF

SEQ ID NO: 3061 - protein, 58 aa, Arabidopsis thaliana
  G2661,HLH/MYC domain
TSTLSTDPQSVAARDRRHRISDRFKILQSMVPGGAKMDTVSMLDEAISYVKFLKAQIW

SEQ ID NO: 3062 - protein, 61 aa, Arabidopsis thaliana
  G2674,HB domain
KRKTKYHRHTSYQIQELESFFKECPHPNEKQRLELGKKLTLESKQIKFWFQNRRTQMKTQL

SEQ ID NO: 3063 - protein, 504 aa, Arabidopsis thaliana
  G268,AKR domain
EYIPCLDNTDVIKKLKSTERGERFERHCPEKGKGLNCLVPPPKGYRQPIPWPKSRDEVWFSNVPHTRLVEDKGGQNWISRDKNKFKFPGGGTQFIHGADQYLDQMSKMVSDITFGKHIRVAMDVGCGVASFGAYLLSRDVMTMSVAPKDVHENQIQFALERGVPAMAAAFATRRLLYPSQAFDLIHCSRCRINWTRDDGILLLEINRMLRAGGYFAWAAQPVYKHEPALEEQWTEMLNLTISLCWKLVKKEGYVAIWQKPFNNDCYLSREAGTKPPLCDESDDPDNVWYTNLKPCISRIPEKGYGGNVPLWPARLHTPPDRLQTIKFDSYIARKELFKAESKYWNEIIGGYVRALKWKKMKLRNVLDMRAGFGGFAAALNDHKLDCWVLSVVPVSGPNTLPVIYDRGLLGVMHDWCEPFDTYPRTYDFLHASGLFSIERKRCEMSTILLEMDRILRPGGRAYIRDSIDVMDEIQEITKAMGWHTSLRDTSEGPHASYRILTCEK

SEQ ID NO: 3064 - protein, 115 aa, Arabidopsis thaliana
  G2682,CPP domain
KGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKN

SEQ ID NO: 3065 - protein, 52 aa, Arabidopsis thaliana
  G2686,WRKY domain
QRCYYRCAYAKDQNCYATKRVQMIQDSPPVYRTTYLGQHTCKAFGVHDNTYG

SEQ ID NO: 3066 - protein, 58 aa, Arabidopsis thaliana
  G2688,WRKY domain
DDGYRWRKYGQKAVKNNKFPRSYYRCTYGGCNVKKQVQRLTVDQEVVVTTYEGVHSHP

SEQ ID NO: 3067 - protein, 69 aa, Arabidopsis thaliana
  G2696,1st SCR domain
YRAFSETSPFLQFVNFTANQTILESFEGFDRIHIVDFDIGYGGQWASLIQELAGKRNRSSSAPSLKITA

SEQ ID NO: 3068 - protein, 77 aa, Arabidopsis thaliana
  G2696,2nd SCR domain
KLLTNRYRWMERSPPWRSLFGQCGFTPVTLSQTAETQAEYLLQRNPMRGFHLEKRQSSSPSLVLCWQRKELVTVSAW

SEQ ID NO: 3069 - protein, 66 aa, Arabidopsis thaliana
  G2697,1st SCR domain
MHILYEACPYFKFGYESANGAIAEAVKNESFVHIIDFQISQGGQWVSLIRALGARPGGPPNVRITG

SEQ ID NO: 3070 - protein, 89 aa, Arabidopsis thaliana
  G2697,2nd SCR domain
LVLHHMPDESVTVENHRDRLLRLVKHLSPNVVTLVEQEANTNTAPFLPRFVETMNHYLAVFESIDVKLARDHKERINVEQHCLAREVVN

SEQ ID NO: 3071 - protein, 73 aa, Arabidopsis thaliana
  G2697,3rd SCR domain
CEGVEREERHEPLGKWRSRFHMAGFKPYPLSSYVNATIKGLLESYSEKYTLEERDGALYLGWKNQPLITSCAW

SEQ ID NO: 3072 - protein, 66 aa, Arabidopsis thaliana
  G2699,1st SCR domain
LAAFVDLTPWHRFGFIAANAAILTAVEGYSTVHIVDLSLTHCMQIPTLIDAMASRLNKPPPLLKLT

SEQ ID NO: 3073 - protein, 91 aa, Arabidopsis thaliana
  G2699,2nd SCR domain
MMLRYIPEEPLTSSSSSLRTVFLKQLRSLNPRIVTLIEEDVDLTSENLVNRLKSAFNYFWIPFDTTDTFMSEQRRWYEAEISWKIENVVAK

SEQ ID NO: 3074 - protein, 75 aa, Arabidopsis thaliana
  G2699,3rd SCR domain
KEGAERVERTETKRRWIERMREAEFGGVRVKEDAVADVKAMLEEHAVGWGMKKEDDDESLVLTWKGHSVVFATVW

SEQ ID NO: 3075 - protein, 101 aa, Arabidopsis thaliana
  G2704,MYB-(R1)R2R3 domain
KGQWTPTEDELLVRMVKSKGTKNWTSIAKMFQGRVGKQCRERWHNHLRPNIKKNDWSEEEDQILIEVHKIVGNKWTEIAKRLPGRSENIVKNHWNATKRRL

SEQ ID NO: 3076 - protein, 61 aa, Arabidopsis thaliana
  G2710,HB domain
WKPNQHQAQILEELFIGGTVNPSLTSIKQITIKLQSYGEEVDDADVYKWFHNRKYSRKPKS

SEQ ID NO: 3077 - protein, 61 aa, Arabidopsis thaliana
  G2712,HB domain
GRRRKKLRLTKEQSHLLEESFIQNHTLTPKQKKDLATFLKLSQRQVEVWFQNRRARSKLKH

SEQ ID NO: 3078 - protein, 86 aa, Arabidopsis thaliana
  G2715,MYB-(R1)R2R3 domain
IVTWSQEEDVILREQITLHGTENWAIIASKFKDKSTRQCRRRWYTYLNSDFKRGGWSPEEDMLLCEAQRVFGNRWTEIAKVVSGRT

SEQ ID NO: 3079 - protein, 99 aa, Arabidopsis thaliana
  G2719,MYB-(R1)R2R3 domain
KGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLR

SEQ ID NO: 3080 - protein, 105 aa, Arabidopsis thaliana
  G2720,MYB-(R1)R2R3 domain
KGPWKAEEDEVLINHVKRYGPRDWSSIRSKGLLQRTGKSCRLRWVNKLRPNLKNGCKFSADEERTVIELQSEFGNKWARIATYLPGRTDNDVKNFWSSRQKRLAR

SEQ ID NO: 3081 - protein, 51 aa, Arabidopsis thaliana
  G2721,MYB-related domain
SPWTFSQNKMFERALAVYDKDTPDRWHNVAKAVGGKTVEEVKRHYDILVED

SEQ ID NO: 3082 - protein, 51 aa, Arabidopsis thaliana
  G2723,MYB-related domain
SSWTSKQNKMFERALAVYDKDTPDRWQNVAKAVGSKSAEEVKRHYDILVED

SEQ ID NO: 3083 - protein, 107 aa, Arabidopsis thaliana
  G2724,MYB-(R1)R2R3 domain
RGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLK

SEQ ID NO: 3084 - protein, 518 aa, Arabidopsis thaliana
  G273,AKR domain
EIIPCLDRNFIYQMRLKLDLSLMEHYERHCPPPERRFNCLIPPPSGYKVPIKWPKSRDEVWKANIPHTHLAKEKSDQNWMVEKGEKISFPGGGTHFHYGADKYIASIANMLNFSNDVLNDEGRLRTVLDVGCGVASFGAYLLASDIMTMSLAPNDVHQNQIQFALERGIPAYLGVLGTKRLPYPSRSFEFAHCSRCRIDWLQRDGLLLLELDRVLRPGGYFAYSSPEAYAQDEENLKIWKEMSALVERMCWRIAVKRNQTVVWQKPLSNDCYLEREPGTQPPLCRSDADPDAVAGVSMEACITPYSKHDHKTKGSGLAPWPARLTSSPPRLADFGYSTDMFEKDTELWKQQVDSYWNLMSSKVKSNTVRNIMDMKAHMGSFAAALKDKDVWVMNVVSPDGPNTLKLIYDRGLIGTNHNWCEAFSTYPRTYDLLHAWSIFSDIKSKGCSAEDLLIEMDRILRPTGFVIIRDKQSVVESIKKYLQALHWETVASEKVNTSSELDQDSEDGENNVVFIVQK

SEQ ID NO: 3085 - protein, 67 aa, Arabidopsis thaliana
  G2739,1st SCR domain
YKTLNDACPYSKFAHLTANQAILEATNQSNNIHIVDFGIFQGIQWSALLQALATRSSGKPTRIRISG

SEQ ID NO: 3086 - protein, 90 aa, Arabidopsis thaliana
  G2739,2nd SCR domain
VNFMLELYKLLDETATTVGTALRLARSLNPRIVTLGEYEVSLNRVEFANRVKNSLRFYSAVFESLEPNLDRDSKERLRVERVLFGRRIMD

SEQ ID NO: 3087 - protein, 76 aa, Arabidopsis thaliana
  G2739,3rd SCR domain
NKPGTRFGLMEEKEQWRVLMEKAGFEPVKPSNYAVSQAKLLLWNYNYSTLYSLVESEPGFISLAWNNVPLLTVSSW

SEQ ID NO: 3088 - protein, 507 aa, Arabidopsis thaliana
  G274,AKR domain
DYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATK

SEQ ID NO: 3089 - protein, 49 aa, Arabidopsis thaliana
  G2742,GARP domain
WTPELHRSFVHAVDLLGGQYKATPKLVLKIMDVKGLTISHVKSHLQMYR

SEQ ID NO: 3090 - protein, 95 aa, Arabidopsis thaliana
  G2747,ABI3/VP-1 domain
REHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQR

SEQ ID NO: 3091 - protein, 58 aa, Arabidopsis thaliana
  G2748,TEO domain
KDRHSKVLTSKGLRDRRIRLSVATAIQFYDLQDRLGFDQPSKAVEWLINAASDSITDL

SEQ ID NO: 3092 - protein, 489 aa, Arabidopsis thaliana
  G2750,AKR domain
NYMPCIDNDGLIGRLQSYRHRERSCPKKPVMCLVPLPHDGYDPPVSWPESKSKILYKNVAHPKLAAYIKKHNWVNETGEYLSFPQNQTTFNGNVLQYLEFIQEMVPDIEWGKNVRIVLDIGCSDSSFVAALLDKDVLTVSLGLKDDLVDLAQVALERGFPTFVSSLASRRLPFPSGVFDTIHCAACGVHWHSHGGKLLLEMNRILRPNGYFILSSNNDKIEDDEAMTALTASICWNILAHKTEEASEMGVRIYQKPESNDIYELRRKKNPPLCEDNENPDAAWYVPMKTCIYEIPSAIEQHGAEWPEEWPKRLETYPEWLTSKEKAMEDTNHWNAMVNKSYLTGLGIDWLHIRNVMDMTAIYGGFGASLVKQNVWVMNVVPVHSPDTLPFIYERGLLGIYHDWCEPFGTYPRSYDLLHADHLFSRLKNRCKQPASIVVEMDRLTRPGGWVVVRDKVEILEPLEEILRSLHWEIRMTYAQDKEGMLCAQK

SEQ ID NO: 3093 - protein, 196 aa, Arabidopsis thaliana
  G2754,1st SWI/SNF domain
TGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESW

SEQ ID NO: 3094 - protein, 85 aa, Arabidopsis thaliana
  G2754,2nd SWI/SNF domain
DIMDYYFSEKGFEVCRIDGSVKLDERRRQIKDFSDEKSSCSIFLLSTRAGGLGINLTAADTCILYDSDWNPQMDLQAMDRCHRIG

SEQ ID NO: 3095 - protein, 59 aa, Arabidopsis thaliana
  G2766,HLH/MYC domain
KRGFATHPRSIAERERRTRISGKLKKLQELVPNMDKQTSYADMLDLAVEHIKGLQHQVE

SEQ ID NO: 3096 - protein, 146 aa, Arabidopsis thaliana
  G277,AKR domain
RGWNPLHIKARKGDLKSVKQLLDQGMDVNALAWGPKSKGVSALHLAAEGGHIEVMDLLLERGANIDAKTWGSCGWTPLHAAAKERKREAVKFLVENGAFLADDITDTRFNPPVHYCHGLEWAYEEMKKLNSESSSSSGGDTSSSSD

SEQ ID NO: 3097 - protein, 58 aa, Arabidopsis thaliana
  G2774,HLH/MYC domain
RPRLETLSPLPSFKVRKEKLGDRITALQQLVSPFGKTDTASVLNEAVEYIKFLQEQVT

SEQ ID NO: 3098 - protein, 59 aa, Arabidopsis thaliana
  G2779,HLH/MYC domain
RRGQATDSHSLAERVRRGKINERLRCLQDMVPGCYKAMGMATMLDEIINYVQSLQNQVE

SEQ ID NO: 3099 - protein, 9 aa, Arabidopsis thaliana
  G2789,1st AT-hook domain
RRPRGRPAG

SEQ ID NO: 3100 - protein, 141 aa, Arabidopsis thaliana
  G2789,2nd AT-hook domain
SKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEE

SEQ ID NO: 3101 - protein, 73 aa, Arabidopsis thaliana
  G279,HMG domain
DPNKPKRPSSAFFVFMEDFRVTYKEEHPKNKSVAAVGKAGGEKWKSLSDSEKAPYVAKADKRKVEYEKNMKAY

SEQ ID NO: 3102 - protein, 58 aa, Arabidopsis thaliana
  G2790,HLH/MYC domain
GKRNQEKSSVGIAKVRKERLGERIAALQQLVSPYGKTDAASVLHEAMGYIKFLQDQIQ

SEQ ID NO: 3103 - protein, 58 aa, Arabidopsis thaliana
  G2791,HLH/MYC domain
RRGQATDPHSIAERLRRERIAERMKSLQELVPNTNKTDKASMLDEIIEYVRFLQLQVK

SEQ ID NO: 3104 - protein, 58 aa, Arabidopsis thaliana
  G2792,HLH/MYC domain
AKCSEGSTLSPEKELPKAKLRDKITTLQQIVSPFGKTDTASVLQEAITYINFYQEQVK

SEQ ID NO: 3105 - protein, 64 aa, Arabidopsis thaliana
  G28,AP2 domain
GKHYRGVRQRPWGKFAAEIRDPAKNGARVWLGTFETAEDAALAYDRAAFRMRGSRALLNFPLRV

SEQ ID NO: 3106 - protein, 8 aa, Arabidopsis thaliana
  G280,1st AT-hook domain
KRGRGRPP

SEQ ID NO: 3107 - protein, 8 aa, Arabidopsis thaliana
  G280,2nd AT-hook domain
PRSRGRPP

SEQ ID NO: 3108 - protein, 8 aa, Arabidopsis thaliana
  G280,3rd AT-hook domain
GRPRGRPP

SEQ ID NO: 3109 - protein, 8 aa, Arabidopsis thaliana
  G280,4th AT-hook domain
RRGRGRPP

SEQ ID NO: 3110 - protein, 140 aa, Arabidopsis thaliana
  G2800,NAC domain
LPPGFKFVPNDEEVIHCYLKPYSDGNTNVLLHVPIHLVNIYESNPQTLSEEFQKGNDKEWFIITERNKVDQGLSQTKRVGYGAKRQKRVDTNGGYWHATVAAQKINAGDGVVRNKRPLAYYVGKPSEGVKTDWLMQEYSL

SEQ ID NO: 3111 - protein, 149 aa, Arabidopsis thaliana
  G2802,NAC domain
LPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHL

SEQ ID NO: 3112 - protein, 153 aa, Arabidopsis thaliana
  G2803,NAC domain
LPVGMRFRPSDLELAVYFLIKKALGLPMKALTVPDECNDIFSTHPRDLPGYGSEEHWYFYCKKPKNQVTRTKSYNLWIPTGEKTDVLDPKKNGGELVGIKHSFTFIENEEEEESDNKNGDEEEPPQCNWFLDEISLPLTVVDTDWTLCHIFYE

SEQ ID NO: 3113 - protein, 93 aa, Arabidopsis thaliana
  G2804,NAC domain
REFEKGNDKEWFIITERNKVDQGLSQTKRVGNGAKRQKRVDTNGGYWHATVAAQKINAGDGVVGNKRPLAYYDRKPSEDVKTDWLMQEYSLDH

SEQ ID NO: 3114 - protein, 61 aa, Arabidopsis thaliana
  G2809,HB domain
RWTPTSTQLQILESIYDEGSGTPNRRRIREIATELSEHGQITETNVYNWFQNRRARSKRKQ

SEQ ID NO: 3115 - protein, 216 aa, Arabidopsis thaliana
  G2818,1st SWI/SNF domain
LIIPLLKYQKEFLAWATIQELSAVRGGILADEMGMGKTIQAISLVLARREVDRAKSREAVGHTLVLVPPVALSQWLDEISRLTSPGSTRVLQYHGPKRDKNVQKLMNYDFVLTTSPIVENEYRKDEGVDETMSPLHSIKWNRIIVDEAHDIKNRSSRTAKAVFALEATYRWALSGTPLQNDVDELYSLIRFLRVSPYSYYFCKKCDCEVLDRSAHR

SEQ ID NO: 3116 - protein, 84 aa, Arabidopsis thaliana
  G2818,2nd SWI/SNF domain
DLISYALGKSGVSCVQLVGSMSKAAKDAALKNFKEEPDCRVLLMSLQAGGVALNLTAASHVFMMDPWWNPAVERQAQDRIHRIG

SEQ ID NO: 3117 - protein, 21 aa, Arabidopsis thaliana
  G2826,Z-C2H2 domain
CQYCCREFGNSQALGGHQNAH

SEQ ID NO: 3118 - protein, 21 aa, Arabidopsis thaliana
  G2831,1st Z-C2H2 domain
CEICGKGFQRDQNLQLHRRGH

SEQ ID NO: 3119 - protein, 21 aa, Arabidopsis thaliana
  G2831,2nd Z-C2H2 domain
CEKCAKRYAVQSDWKAHSKTC

SEQ ID NO: 3120 - protein, 22 aa, Arabidopsis thaliana
  G2836,Z-C2H2 domain
CLKCNSLFDTSQMLVVHTELIH

SEQ ID NO: 3121 - protein, 21 aa, Arabidopsis thaliana
  G2837,Z-C2H2 domain
CHICGRGFGSWKAVFGHMRAH

SEQ ID NO: 3122 - protein, 21 aa, Arabidopsis thaliana
  G2838,Z-C2H2 domain
CHYCFRNFPTSQALGGHQNAH

SEQ ID NO: 3123 - protein, 21 aa, Arabidopsis thaliana
  G2840,1st Z-C2H2 domain
CQICGKGFKRDANLRMHMRAH

SEQ ID NO: 3124 - protein, 32 aa, Arabidopsis thaliana
  G2840,2nd Z-C2H2 domain
CPQHGCRWNQRHEKFQPLKSVICAKNHYKRSH

SEQ ID NO: 3125 - protein, 22 aa, Arabidopsis thaliana
  G2840,3rd Z-C2H2 domain
CRRCSVKHFSVLSDLRTHEKHC

SEQ ID NO: 3126 - protein, 55 aa, Arabidopsis thaliana
  G2848,HLH/MYC domain
HKSSDLSFSSKERKDKLAERISALQQLVSPYGKTDTASVLLEGMQYIQFLQEQVK

SEQ ID NO: 3127 - protein, 54 aa, Arabidopsis thaliana
  G2849,HLH/MYC domain
HKSDLSFSSKERKDKVGERISALQQIVSPYGKTDTASVLLDAMHYIEFLHEQVK

SEQ ID NO: 3128 - protein, 181 aa, Arabidopsis thaliana
  G2855,ACBF-like domain
DDVKTLWVGDLLHWMDETYLHSCFSHTGEVSSVKVIRNKLTSQSEGYGFVEFLSRAAAEEVLQNYSGSVMPNSDQPFRINWASFSTGEKRAVENGPDLSVFVGDLSPDVTDVLLHETFSDRYPSVKSAKVVIDSNTGRSKGYGFVRFGDENERSRALTEMNGAYCSNRQMRVGIATPKRAI

SEQ ID NO: 3129 - protein, 311 aa, Arabidopsis thaliana
  G2856,ACBF-like domain
TLWIGDLQYWVDENYLTSCFSQTGELVSVKVIRNKITGQPEGYGFIEFISHAAAERTLQTYNGTQMPGTELTFRLNWASFGSGQKVDAGPDHSIFVGDLAPDVTDYLLQETFRVHYSSVRGAKVVTDPSTGRSKGYGFVKFAEESERNRAMAEMNGLYCSTRPMRISAATPKKNVGVQQQYVTKAVYPVTVPSAVAAPVQAYVAPPESDVTCTTISVANLDQNVTEEELKKAFSQLGEVIYVKIPATKGYGYVQFKTRPSAEEAVQRMQGQVIGQQAVRISWSKNPGQDGWVTQADPNQWNGYYGYGQGYD

SEQ ID NO: 3130 - protein, 47 aa, Arabidopsis thaliana
  G286,1st ENBP domain
CHQCQRKDRERIISCLKCNQRAFCHNCLSARYSEISLEEVEKVCPAC

SEQ ID NO: 3131 - protein, 78 aa, Arabidopsis thaliana
  G286,2nd ENBP domain
CNVCRIPVVDYYRHCPNCSYDLCLRCCQDLREESSVTISGTNQNVQDRKGAPKLKLNFSYKFPEWEANGDGSIPCPPK

SEQ ID NO: 3132 - protein, 199 aa, Arabidopsis thaliana
  G286,3rd ENBP domain
IFYQRPEFIRSFPFLEYIHPRLGLLNVAAKLPHYSLQNDSGPKIYVSCGTYQEISAGDSLTGIHYNMRDMVYLLVHTSEETTFERVRKTKPVPEEPDQKMSENESLLSPEQKLRDGELHDLSLGEASMEKNEPELALTVNPENLTENGDNMESSCTSSCAGGAQWDVFRRQDVPKLSGYLQRTFQKPDNIQTDFVSRTC

SEQ ID NO: 3133 - protein, 502 aa, Arabidopsis thaliana
  G2876,AKR domain
DYIPCLDNEEEIKRLNNTDRGENYERHCPKQSLDCLIPPPDGYKKPIQWPQSRDKIWFNNVPHTRLVEDKGGQNWIRREKDKFVFPGGGTQFIHGADQYLDQISQMIPDITFGSRTRVALDIGCGVASFGAFLMQRNTTTLSVAPKDVHENQIQFALERGVPAMVAVFATRRLLYPSQSFEMIHCSRCRINWTRDDGILLLEVNRMLRAGGYFVWAAQPVYKHEDNLQEQWKEMLDLTNRICWELIKKEGYIAVWRKPLNNSCYVSREAGTKPPLCRPDDDPDDVWYVDMKPCITRLPDNGYGANVSTWPARLHDPPERLQSIQMDAYISRKEIMKAESRFWLEVVESYVRVFRWKEFKLRNVLDMRAGFGGFAAALNDLGLDCWVMNIVPVSGFNTLPVIYDRGLQGAMHDWCEPFDTYPRTYDLIHAAFLFSVEKKRCNITNIMLEMDRMLRPGGHVYIRDSLSLMDQLQQVAKAIGWTAGVHDTGEGPHASVRILICDK

SEQ ID NO: 3134 - protein, 53 aa, Arabidopsis thaliana
  G288,MISC domain
VSLSCPISRKRIKLPVKGQLCKHLQCFDFSNYVHINMRNPTWRCPHCNQPVCY

SEQ ID NO: 3135 - protein, 48 aa, Arabidopsis thaliana
  G2885,GARP domain
WSQELHQKFVSAVQQLGLDKAVPKKILDLMSIEGLTRENVASHLQKYR

SEQ ID NO: 3136 - protein, 177 aa, Arabidopsis thaliana
  G2887,NAC domain
TQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEE

SEQ ID NO: 3137 - protein, 503 aa, Arabidopsis thaliana
  G2891,AKR domain
EYIPCHNVTYVQQLLPSLNLSRREELERHCPPLEQRLFCLVPPPKDYKIPIRWPTSRDYVWRSNVNHTHLAEVKGGQNWVHEQGQLWWFPGGGTHFKHGAPEYIQRLGNMTTNETGDLLSAGVEQVLDVGCGVASFAAYLLPLGIKTMSFAPKDGHENQIQFALERGIRAMISAIATKQMPYPAASFDMVHCSRCRVDWHENDGVLMKEVNRLLRPNGYFVYSAPPAYRKDKDFPVIWDKLVNLTSAMCWKLISRKVQTAIWVKEDDEACLRKNAELELITICGVEDVSKASWKVPLRDCVDISENRQQKPSSLTDRLSSYPTSLREKGISEDEFTLDTNFWREQVNQYWELMNVNKTEVRNVMDTNAFIGGFAAAMNSYPLWVMNVVPATMNDTLSGIYQRGLTGAYHDWCEPFSTYPRTYDLLHADHLFTHYKIYGEGCLLEDIMLEMDRIIRPQGFIIIRDEESIVSRVRDLAPKFLWEVEAHELQDKYKKTETVLFCRK

SEQ ID NO: 3138 - protein, 102 aa, Arabidopsis thaliana
  G2893,MYB-(R1)R2R3 domain
RKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQK

SEQ ID NO: 3139 - protein, 73 aa, Arabidopsis thaliana
  G2896,HMG domain
DPNRPKKPPSPFFVFLDDFRKEFNLANPDNKSVGNVGRAAGKKWKTMTEEERAPFVAKSQSKKTEYAVTMQQY

SEQ ID NO: 3140 - protein, 73 aa, Arabidopsis thaliana
  G2898,HMG domain
QTKMPKKPATAFFFFLDDFRKQYQEENPDVKSMREIGKTCGEKWKTMTYEEKVKYYDIATEKREEFHRAMTEY

SEQ ID NO: 3141 - protein, 64 aa, Arabidopsis thaliana
  G29,AP2 domain
KRHYRGVRMRPWGKFAAEIRDPTRRGTRVWLGTFETAIEAARAYDKEAFRLRGSKAILNFPLEV

SEQ ID NO: 3142 - protein, 247 aa, Arabidopsis thaliana
  G290,1st SWI/SNF domain
LAVSLLRHQRIALSWMSQKETSGNPCFGGILADDQGLGKTVSTIALILTERSTPYLPCEEDSKNGGCNQSDHSQVVFNENKVVEDSLCKMRGRPAAGTLIVCPTSLMRQWADELRKKVTLEAHLSVLVYHGCSRTKDPHELAKYDVVITTYSLVSKRKHMDCEPVEFLSGPLAQVSWFRVVLDEAQSIKNYKTQASIACSGLHAKRRWCLSGTPIQNSIADLYSYFRFLKYDPYSSYQTFCETIKNP

SEQ ID NO: 3143 - protein, 40 aa, Arabidopsis thaliana
  G290,2nd SWI/SNF domain
CGICNVRLSTHAVVSLCGHVFCNQCICECLTRDNNQCPLS

SEQ ID NO: 3144 - protein, 84 aa, Arabidopsis thaliana
  G290,3rd SWI/SNF domain
DLLEAGLKSSGIQYRRFDGKMTVPARDAAVQDFNTLPDVSVMIMSLKAASLGLNMVAACHVIMLDLWWNPTTEDQAIDRAHRIG

SEQ ID NO: 3145 - protein, 71 aa, Arabidopsis thaliana
  G2902,1st HMG domain
ETKRPSTPYILWCKDNWNEVKKQNPEADFKETSNILGAKWKGISAEEKKPYEEKYQADKEAYLQVITKEKR

SEQ ID NO: 3146 - protein, 70 aa, Arabidopsis thaliana
  G2902,2nd HMG domain
DPLKPKQPISAYLIYANERRAALKGENKSVIEVAKMAGEEWKNLSEEKKAPYDQMAKKNKEIYLQEMEGY

SEQ ID NO: 3147 - protein, 71 aa, Arabidopsis thaliana
  G2902,3rd HMG domain
KPKKPTSSYFLFCKDARKSVLEEHPGINNSTVTAHISLKWMELGEEEKQVYNSKAAELMEAYKKEVEEYNK

SEQ ID NO: 3148 - protein, 22 aa, Arabidopsis thaliana
  G2906,Z-C2H2 domain
CGVCDRRFYTNEKLINHFKQIH

SEQ ID NO: 3149 - protein, 109 aa, Arabidopsis thaliana
  G2910,1st PCGL domain
DLDIQTMLDEAYSRWLRPNEIHALLCNHKFFTINVKPVNLPKSGTIVLFDRKMLRNFRKDGHNWKKKKDGKTIKEAHEHLKVGNEERIHVYYAHGEDTPTFVRRCYWLL

SEQ ID NO: 3150 - protein, 70 aa, Arabidopsis thaliana
  G2910,2nd PCGL domain
AAAARIQYRFQTWKMRREFLNMRKKAIRIQAAFRGFQVRRQYQKITWSVGVLEKAILRWRLKRKGFRGLQ

SEQ ID NO: 3151 - protein, 36 aa, Arabidopsis thaliana
  G2918,1st JUMONJI domain
APVFNPTEEEFRDTLSYISSLRDRAEPYGICCVVPP

SEQ ID NO: 3152 - protein, 153 aa, Arabidopsis thaliana
  G2918,2nd JUMONJI domain
SGWNLNSTAKLPGSLLSLEDCESVCVPRLSVGMCLSSQFWKSEKERLYSLCYLHVGAPRVWYSVAGCHRSKFKAAMKSFILEMSGEQPKKSHNPVMMMSPYQLSVEGIPVTRCVQHPGQYVIIFPGSYYSAFDCGFNCLEKANFAPLDWLPHG

SEQ ID NO: 3153 - protein, 65 aa, Arabidopsis thaliana
  G2921,1st JUMONJI domain
IINDAPVFTPSLEEFVDPLAYIEKIRPLAEPYGICRIIPPSTWKPPCRLKEKSIWEQTKFPTRIQ

SEQ ID NO: 3154 - protein, 153 aa, Arabidopsis thaliana
  G2921,2nd JUMONJI domain
WNLNNLPRLPGSVLSFEDCDISGVLVPWLYVGMCFSSFCWHVEDHHLYSLNYHHFGEPKVWYGVPGSNATALEKAMRKHLPDLFEEQPDLLHGLVTQFSPSILKDEGVQAYRVVQNSGEYVLTFPRAYHAGFNCGFNCAEAVNVAPVDWLAHG

SEQ ID NO: 3155 - protein, 58 aa, Arabidopsis thaliana
  G2927,HLH/MYC domain
GPSATQLQHMISERKRREKLNESFQALRSLLPPGTKKDKASVLSIAREQLSSLQGEIS

SEQ ID NO: 3156 - protein, 61 aa, Arabidopsis thaliana
  G2929,HLH/MYC domain
DRESKKMKHRDIERQRRQEVSSLFKRLRTLLPFQYIQGKRSTSDHIVQAVNYIKDLQIKIK

SEQ ID NO: 3157 - protein, 64 aa, Arabidopsis thaliana
  G2930,HLH/MYC domain
SGAAKKQDHNAKERLRRMRLHASYLTLGTLLPDHSSSSSKKKWSAPSIIDNVITYIPKLQNEVG

SEQ ID NO: 3158 - protein, 61 aa, Arabidopsis thaliana
  G2931,HLH/MYC domain
EPKNKRAKHKELERQRRQENTSLFKILRYLLPSQYIKGKRSSADHVLEAVNYIKDLQKKIK

SEQ ID NO: 3159 - protein, 61 aa, Arabidopsis thaliana
  G2936,HLH/MYC domain
VVLEKKLNHNASERDRRRKLNALYSSLRALLPLSDQKRKLSIPMTVARVVKYIPEQKQELQ

SEQ ID NO: 3160 - protein, 68 aa, Arabidopsis thaliana
  G295,bZIP domain
TAEKQFVDKKLRRKIKNRESAARSRARKQAQTMEVEVELENLKKDYEELLKQHVELRKRQMEPGMISL

SEQ ID NO: 3161 - protein, 22 aa, Arabidopsis thaliana
  G2965,Z-C2H2 domain
CPHCKITVPDLKTMQIHHESKH

SEQ ID NO: 3162 - protein, 22 aa, Arabidopsis thaliana
  G2966,Z-C2H2 domain
CHKCGEQFNKLEAAEAHHLSKH

SEQ ID NO: 3163 - protein, 25 aa, Arabidopsis thaliana
  G2972,1st Z-C2H2 domain
CKTCGRKFGTLKGVYGHQRMHSGNH

SEQ ID NO: 3164 - protein, 21 aa, Arabidopsis thaliana
  G2972,2nd Z-C2H2 domain
CSICEKSFVCSQALGSHQRLH

SEQ ID NO: 3165 - protein, 18 aa, Arabidopsis thaliana
  G2972,3rd Z-C2H2 domain
CGKSFVCSQALGGHQTLH

SEQ ID NO: 3166 - protein, 20 aa, Arabidopsis thaliana
  G2979,E2F domain
VRRLYDIANVFASMNLIEKT

SEQ ID NO: 3167 - protein, 299 aa, Arabidopsis thaliana
  G2980,E2F domain
LDDAAAKLGVERRRIYDVVNILESIGLVARSGKNQYSWKGFGAVPRALSELKEEGMKEKFAIVPFVAKSEMVVYEKEGEESFMLSPDDQEFSPSPRPDNRKERTLWLLAQNFVKLFLCSDDDLVTFDSATKALLNESQDMNMRKKVRRLYDIANVFSSMKLIEKTHVPETKKPAYRWLGSKTIFENRFIDGSASLCDRNVPKKRAFGTELTNVNAKRNKSGCSKEDSKRNGNQNTSIVIKQEQCDDVKPDVKNFASGSSTPAGTSESNDMGNNIRPRGRLGVIEALSTLYQPSYCNPEL

SEQ ID NO: 3168 - protein, 18 aa, Arabidopsis thaliana
  G2982,E2F domain
RRVYDALNVFMALDIIAR

SEQ ID NO: 3169 - protein, 61 aa, Arabidopsis thaliana
  G2983,HB domain
RWNPTQEQIGILEMLYKGGMRTPNAQQIEHITLQLGKYGKIEGKNVFYWFQNHKARERQKQ

SEQ ID NO: 3170 - protein, 136 aa, Arabidopsis thaliana
  G2985,OTHER domain
CNKRPVPGRKRCEDHKGMRINAFLFLLNQTDREKTVKDEKPDPESHTESIEEEALTRFCEATTKNGLPCTRSSPKGSKRCWQHKEKTSSDTSPVYFQPEAAKNVACGVKLGNGLICERSPVKGRKRCEEHKGMRIT

SEQ ID NO: 3171 - protein, 56 aa, Arabidopsis thaliana
  G2989,1st ZF-HB domain
VTYKECLKNHAAAIGGHALDGCGEFMPSPSSTPSDPTSLKCAACGCHRNFHRRETD

SEQ ID NO: 3172 - protein, 64 aa, Arabidopsis thaliana
  G2989,2nd ZF-HB domain
RKRFRTKFSSNQKEKMHEFADRIGWKIQKRDEDEVRDFCREIGVDKGVLKVWMHNNKNSFKFSG

SEQ ID NO: 3173 - protein, 56 aa, Arabidopsis thaliana
  G2990,1st ZF-HB domain
FTYKECLKNHAAALGGHALDGCGEFMPSPSSISSDPTSLKCAACGCHRNFHRRDPD

SEQ ID NO: 3174 - protein, 64 aa, Arabidopsis thaliana
  G2990,2nd ZF-HB domain
RKRFRTKFSQFQKEKMHEFAERVGWKMQKRDEDDVRDFCRQIGVDKSVLKVWMHNNKNTFNRRD

SEQ ID NO: 3175 - protein, 56 aa, Arabidopsis thaliana
  G2992,1st ZF-HB domain
VCYKECLKNHAANLGGHALDGCGEFMPSPTATSTDPSSLRCAACGCHRNFHRRDPS

SEQ ID NO: 3176 - protein, 64 aa, Arabidopsis thaliana
  G2992,2nd ZF-HB domain
RKRTRTKFTPEQKIKMRAFAEKAGWKINGCDEKSVREFCNEVGIERGVLKVWMHNNKYSLLNGK

SEQ ID NO: 3177 - protein, 54 aa, Arabidopsis thaliana
  G2993,1st ZF-HB domain
IKYKECLKNHAATMGGNAIDGCGEFMPSGEEGSIEALTCSVCNCHRNFHRRETE

SEQ ID NO: 3178 - protein, 64 aa, Arabidopsis thaliana
  G2993,2nd ZF-HB domain
KKRFRTKFTQEQKEKMISFAERVGWKIQRQEESVVQQLCQEIGIRRRVLKVWMHNNKQNLSKKS

SEQ ID NO: 3179 - protein, 56 aa, Arabidopsis thaliana
  G2995,1st ZF-HB domain
VLYNECLKNHAVSLGGHALDGCGEFTPKSTTILTDPPSLRCDACGCHRNFHRRSPS

SEQ ID NO: 3180 - protein, 64 aa, Arabidopsis thaliana
  G2995,2nd ZF-HB domain
KKHKRTKFTAEQKVKMRGFAERAGWKINGWDEKWVREFCSEVGIERKVLKVWIHNNKYFNNGRS

SEQ ID NO: 3181 - protein, 54 aa, Arabidopsis thaliana
  G2996,1st ZF-HB domain
FRFRECLKNQAVNIGGHAVDGCGEFMPAGIEGTIDALKCAACGCHRNFHRKELP

SEQ ID NO: 3182 - protein, 64 aa, Arabidopsis thaliana
  G2996,2nd ZF-HB domain
RKRHRTKFTAEQKERMLALAERIGWRIQRQDDEVIQRFCQETGVPRQVLKVWLHNNKHTLGKSP

SEQ ID NO: 3183 - protein, 54 aa, Arabidopsis thaliana
  G2998,1st ZF-HB domain
VRYRECLKNHAASVGGSVHDGCGEFMPSGEEGTIEALRCAACDCHRNFHRKEMD

SEQ ID NO: 3184 - protein, 64 aa, Arabidopsis thaliana
  G2998,2nd ZF-HB domain
KKRFRTKFTTDQKERMMDFAEKLGWRMNKQDEEELKRFCGEIGVKRQVFKVWMHNNKNNAKKPP

SEQ ID NO: 3185 - protein, 54 aa, Arabidopsis thaliana
  G2999,1st ZF-HB domain
ARYRECQKNHAASSGGHVVDGCGEFMSSGEEGTVESLLCAACDCHRSFHRKEID

SEQ ID NO: 3186 - protein, 64 aa, Arabidopsis thaliana
  G2999,2nd ZF-HB domain
KKRFRTKFNEEQKEKMMEFAEKIGWRMTKLEDDEVNRFCREIKVKRQVFKVWMHNNKQAAKKKD

SEQ ID NO: 3187 - protein, 68 aa, Arabidopsis thaliana
  G3,AP2 domain
RKPYRGIRRRKWGKWVAEIREPNKRSRLWLGSYTTDIAAARAYDVAVFYLRGPSARLNFPDLLLQEED

SEQ ID NO: 3188 - protein, 65 aa, Arabidopsis thaliana
  G30,AP2 domain
EQGKYRGVRRRPWGKYAAEIRDSRKHGERVWLGTFDTAEDAARAYDRAAYSMRGKAAILNFPHEY

SEQ ID NO: 3189 - protein, 116 aa, Arabidopsis thaliana
  G3006,HS domain
VYEVVDDASTDAIISWSESNNSFIIWNVGEFYRRILPKYVDLGTNLSRFFSNLRSHGFKIVKGRTGVLEFGHEDFIRDKLELMKKMVSDKRKARKAAKSKARKARVQVEFLFQHLQ

SEQ ID NO: 3190 - protein, 117 aa, Arabidopsis thaliana
  G3007,1st TUBBY domain
ITGSLSTQKGEDKENVSPEKVSTSVETRKLDRALKSQSMKGNSGFPTEVTNFKSFSTGGRTALKQSSLQACMQKNSEVDKSSFGMKTWTSVDSEHSSSLKVWEFSDSEAAPASSWST

SEQ ID NO: 3191 - protein, 48 aa, Arabidopsis thaliana
  G3007,2nd TUBBY domain
RALLCKTLPLDVGRCTCLIVKEQSPEGLSHGSVYSLYTHEGRGRKDRK

SEQ ID NO: 3192 - protein, 66 aa, Arabidopsis thaliana
  G3009,1st SCR domain
QMNFYDSCPYLKFAHFTANQAILEAVTTSRVVHVIDLGLNQGMQWPALMQALALRPGGPPSFRLTG

SEQ ID NO: 3193 - protein, 88 aa, Arabidopsis thaliana
  G3009,2nd SCR domain
VNSVFELHPVLSQPGSIEKLLATVKAVKPGLVTVVEQEANHNGDVFLDRFNEALHYYSSLFDSLEDGVVIPSQDRVMSEVYLGRQILN

SEQ ID NO: 3194 - protein, 75 aa, Arabidopsis thaliana
  G3009,3rd SCR domain
TEGSDRIERHETLAQWRKRMGSAGFDPVNLGSDAFKQASLLLALSGGGDGYRVEENDGSLMLAWQTKPLIAASAW

SEQ ID NO: 3195 - protein, 58 aa, Arabidopsis thaliana
  G3012,HLH/MYC domain
PTENFKSKNLHSERKRRERINQAMYGLRAVVPKITKLNKIGIFSDAVDYINELLVEKQ

SEQ ID NO: 3196 - protein, 58 aa, Arabidopsis thaliana
  G3021,HLH/MYC domain
DGIRILERPDKEGGNEEGGIEERLRELKKLLPGGEEMNVEEMLSEIGNYIKCLELQTI

SEQ ID NO: 3197 - protein, 61 aa, Arabidopsis thaliana
  G3023,HLH/MYC domain
TGQSRSVDRKTVEKNRRMQMKSLYSELISLLPHHSSTEPLTLPDQLDEAANYIKKLQVNVE

SEQ ID NO: 3198 - protein, 49 aa, Arabidopsis thaliana
  G3032,GARP domain
WTNRLQLVFDDAVVRLGGLFSATPKAINELISEEGLTGDQIRSHLQVLR

SEQ ID NO: 3199 - protein, 49 aa, Arabidopsis thaliana
  G3034,GARP domain
WTTTLHARFVHAVELLGGHERATPKSVLELMDVKDLTLAHVKSHLQMYR

SEQ ID NO: 3200 - protein, 128 aa, Arabidopsis thaliana
  G3037,NAC domain
MRLPPGFRFDPDDEDLVFEYLAKKVLHRPMDFDLPELRSCNVDPWDLLGEKNKEVYYFVKKEERERKGRETLSGYWEECEEEEVMEAGGRDCIHLEGRRKTFAFFIGKKPRGTITPWIMYEFRLLSSR

SEQ ID NO: 3201 - protein, 141 aa, Arabidopsis thaliana
  G3040,NAC domain
LPVGSRFCPTDLGLVRLYLRNKVERNQSSFITTMDIHQDYPWLLPHVNNPLFNNNEWYYFVPLTERGGKILSVHRKVAARGGSEGGTWRSNDGKKEIKDGHMQKGDGLRAVFHSDDLQKVVLCRIRYKKEANVNEFGLVNH

SEQ ID NO: 3202 - protein, 129 aa, Arabidopsis thaliana
  G3041,NAC domain
SLAPGFRFHPTDEELVRYYLKRKICNKPFKFDAISVTDVYKSEPWDLPDKSRLKSRDLEWYFFSMLDKKYRNGSKTNRATEMGYWKTTGKDREILNGSKVVGMKKTLVYHKGRAPRGERTNWVMHEYRL

SEQ ID NO: 3203 - protein, 20 aa, Arabidopsis thaliana
  G3054,1st Z-C3H domain
CFKFRAGTCPYSASSCHFAH

SEQ ID NO: 3204 - protein, 20 aa, Arabidopsis thaliana
  G3054,2nd Z-C3H domain
CNKWQTTGYCPFGSHCHFAH

SEQ ID NO: 3205 - protein, 19 aa, Arabidopsis thaliana
  G3055,1st Z-C3H domain
CCKFRAGTCPYITNCNFAH

SEQ ID NO: 3206 - protein, 20 aa, Arabidopsis thaliana
  G3055,2nd Z-C3H domain
CKKFYTEEGCPYGESCTFLH

SEQ ID NO: 3207 - protein, 22 aa, Arabidopsis thaliana
  G3055,3rd Z-C3H domain
CNKWEITGYCPFGAKCHFAHGA

SEQ ID NO: 3208 - protein, 66 aa, Arabidopsis thaliana
  G306,1st SCR domain
FQVFNGISPLVKFSHFTANQAIQEAFEKEDSVHIIDLDIMQGLQWPGLFHILASRPGGPPHVRLTG

SEQ ID NO: 3209 - protein, 88 aa, Arabidopsis thaliana
  G306,2nd SCR domain
VAVHWLQHSLYDVTGSDAHTLWLLQRLAPKVVTVVEQDLSHAGSFLGRFVEAIHYYSALFDSLGASYGEESEERHVVEQQLLSKEIRN

SEQ ID NO: 3210 - protein, 74 aa, Arabidopsis thaliana
  G306,3rd SCR domain
AVGGPSRSGEVKFESWREKMQQCGFKGISLAGNAATQATLLLGMFPSDGYTLVDDNGTLKLGWKDLSLLTASAW

SEQ ID NO: 3211 - protein, 20 aa, Arabidopsis thaliana
  G3060,1st Z-C3H domain
CTKFFSTSGCPFGENCHFLH

SEQ ID NO: 3212 - protein, 19 aa, Arabidopsis thaliana
  G3060,2nd Z-C3H domain
CERFSKGNCTFGDRCHFAH

SEQ ID NO: 3213 - protein, 21 aa, Arabidopsis thaliana
  G3063,1st Z-C2H2 domain
CEICNKGFQRDQNLQLHRRGH

SEQ ID NO: 3214 - protein, 21 aa, Arabidopsis thaliana
  G3063,2nd Z-C2H2 domain
CEKCSKKYAVQSDWKAHSKIC

SEQ ID NO: 3215 - protein, 22 aa, Arabidopsis thaliana
  G3064,Z-C2H2 domain
CGVCGRKCKTNLDLKKHFKQLH

SEQ ID NO: 3216 - protein, 22 aa, Arabidopsis thaliana
  G3066,1st Z-C2H2 domain
CKECGKGFLYEKCLFNHLQVTH

SEQ ID NO: 3217 - protein, 23 aa, Arabidopsis thaliana
  G3066,2nd Z-C2H2 domain
HRCGLCHKVFSTYQTLGGHQTFH

SEQ ID NO: 3218 - protein, 22 aa, Arabidopsis thaliana
  G3067,Z-C2H2 domain
CHKCGEKFSKLEAAEAHHLTKH

SEQ ID NO: 3219 - protein, 84 aa, Arabidopsis thaliana
  G3074,CAAT domain
KKLDTRFPAARIKKIMQADEDVGKIALAVPVLVSKSLELFLQDLCDRTYEITLERGAKTVSSLHLKHCVERYNVFDFLREVVSK

SEQ ID NO: 3220 - protein, 82 aa, Arabidopsis thaliana
  G3075,CAAT domain
PMNRIRRIMRSDNSAPQIMQDAVFLVNKATEMFIERFSEEAYDSSVKDKKKFIHYKHLSSVVSNDQRYEFLADSVPEKLKAE

SEQ ID NO: 3221 - protein, 31 aa, Arabidopsis thaliana
  G3080,1st bZIP-ZW2 domain
YFAPSWNSPLENGLLWMGGCRPSSFIRVIYS

SEQ ID NO: 3222 - protein, 28 aa, Arabidopsis thaliana
  G3080,2nd bZIP-ZW2 domain
ADKLRFETLRKIVDVVTPVQAAEFLLAG

SEQ ID NO: 3223 - protein, 66 aa, Arabidopsis thaliana
  G309,1st SCR domain
QIHFYESCPYLKFAHFTANQAILEVFATAEKVHVIDLGLNHGLQWPALIQALALRPNGPPDFRLTG

SEQ ID NO: 3224 - protein, 86 aa, Arabidopsis thaliana
  G309,2nd SCR domain
AVNSVFELHRLLAHPGSIDKFLSTIKSIRPDIMTVVEQEANHNGTVFLDRFTESLHYYSSLFDSLEGPPSQDRVMSELFLGRQILN

SEQ ID NO: 3225 - protein, 75 aa, Arabidopsis thaliana
  G309,3rd SCR domain
CEGEDRVERHETLNQWRNRFGLGGFKPVSIGSNAYKQASMLLALYAGADGYNVEENEGCLLLGWQTRPLIATSAW

SEQ ID NO: 3226 - protein, 136 aa, Arabidopsis thaliana
  G3090,PLATZ domain
MMMMATKPAWLEGLMAETFFSSCGIHETRRKSEKNVFCLLCCLSVCPHCLPSHRSHPLLQVRRYVYHDVVRLSDLEKLIDCSYVQPYTINGAKVIFLNQRQQSRAKVSSNVCFTCDRILQEPFHFCSLSCKVDYLS

SEQ ID NO: 3227 - protein, 65 aa, Arabidopsis thaliana
  G3101,Z-C2H2 domain
CSRSTEQMCHEDSRLRISEEEEIAAEESLAAYCKPVELYNIIQRRAIRNPLFLQRCLHYKIEAKH

(The sequence listing continues in the following parts.)

What is claimed is:

1. A transformed plant transformed with an expression vector comprising a recombinant nucleic acid sequence encoding a polypeptide, wherein the polypeptide has at least 95% amino acid identity to SEQ ID NO: 1232, and wherein the transformed plant has greater yield as compared to a control plant that has not been transformed with said expression vector.

2. The transformed plant of claim 1, wherein the polypeptide has at least 98% amino acid identity to SEQ ID NO: 1232.

3. A recombinant plant host cell comprised within the transformed plant of claim 1.

4. A transgenic seed produced by the transformed plant of claim 1, wherein the transgenic seed comprises the expression vector.

5. The transformed plant of claim 1, wherein the transformed plant is a dicot.

6. The transformed plant of claim 1, wherein the polypeptide is SEQ ID NO: 1232.

7. A transformed tomato plant transformed with an expression vector comprising a recombinant nucleic acid sequence encoding a polypeptide, wherein the polypeptide has at least 95% amino acid identity to SEQ ID NO: 1232, and wherein the transformed tomato plant has greater yield, increased lycopene levels, or greater fruit weight as compared to a control plant that has not been transformed with said expression vector.

8. The transformed tomato plant of claim 7, wherein the transformed tomato plant has greater yield as compared to a control plant not transformed with said expression vector.

9. The transformed tomato plant of claim 7, wherein the transformed tomato plant has increased lycopene levels as compared to a control plant not transformed with said expression vector.

10. The transformed tomato plant of claim 7, wherein the transformed tomato plant has greater fruit weight as compared to a control plant not transformed with said expression vector.

11. The transformed tomato plant of claim 7, wherein the polypeptide has at least 98% amino acid identity to SEQ ID NO: 1232.

12. The transformed tomato plant of claim 7, wherein the polypeptide is SEQ ID NO: 1232.

* * * * *